(12) United States Patent
Hu et al.

(10) Patent No.: US 9,920,316 B2
(45) Date of Patent: Mar. 20, 2018

(54) COMPOSITIONS AND METHODS TO CONTROL INSECT PESTS

(71) Applicants: Pioneer Hi-Bred International, Inc., Johnston, IA (US); E. I. du Pont de Nemours and Company, Wilmington, DE (US)

(72) Inventors: Xu Hu, Johnston, IA (US); James Presnail, Des Moines, IA (US); Nina Richtman, Granger, IA (US); Scott Diehn, West Des Moines, IA (US); Michelle Van Allen, West Des Moines, IA (US); Lisa Procyk, Ankeny, IA (US)

(73) Assignees: PIONEER HI-BRED INTERNATIONAL, INC., Johnston, IA (US); E. I. DU PONT DE NEMOURS AND COMPANY, Wilmington, DE (US)

( * ) Notice: Subject to any disclaimer, the term of this patent is extended or adjusted under 35 U.S.C. 154(b) by 437 days.

(21) Appl. No.: 13/831,230

(22) Filed: Mar. 14, 2013

(65) Prior Publication Data

US 2014/0275208 A1 Sep. 18, 2014

(51) Int. Cl.
| | | |
|---|---|---|
| C12N 15/82 | (2006.01) | |
| C12N 15/113 | (2010.01) | |
| A01N 37/46 | (2006.01) | |
| A01N 63/02 | (2006.01) | |

(52) U.S. Cl.
CPC ............ *C12N 15/113* (2013.01); *A01N 37/46* (2013.01); *A01N 63/02* (2013.01); *C12N 15/8218* (2013.01); *C12N 15/8286* (2013.01); *C12N 2310/14* (2013.01); *C12N 2310/531* (2013.01)

(58) Field of Classification Search
None
See application file for complete search history.

(56) References Cited

U.S. PATENT DOCUMENTS

| | | | |
|---|---|---|---|
| 7,612,194 B2 | 11/2009 | Andersen et al. | |
| 8,114,980 B2 | 2/2012 | Plaetinck et al. | |
| 2005/0095199 A1* | 5/2005 | Whyard | A01K 67/0337 424/9.2 |
| 2006/0095987 A1* | 5/2006 | Niblett | 800/279 |
| 2006/0272049 A1* | 11/2006 | Waterhouse | C07K 14/43563 800/279 |
| 2007/0271630 A1* | 11/2007 | Boukharov | C07K 14/4354 800/279 |
| 2012/0164205 A1 | 6/2012 | Baum et al. | 424/409 |
| 2013/0177539 A1 | 7/2013 | Broglie et al. | |
| 2016/0230186 A1 | 8/2016 | Baum et al. | |

FOREIGN PATENT DOCUMENTS

| | | |
|---|---|---|
| WO | 2005110068 A2 | 11/2005 |
| WO | 2007035650 A2 | 3/2007 |
| WO | 2009055534 A1 | 4/2009 |

OTHER PUBLICATIONS

Elomaa et al. (Molecular Breeding (1996) 2:41-50.*
Colliver et al. (Plant Molecular Biology (1997) 35:509-522).*
Emery et al. (Current Biology (2003) 13:1768-1774).*
Kim et al, Nucleic Acids Research, 2010, vol. 38, Database issue D437-D442.*
International Search Report and Written Opinion mailed Dec. 5, 2014 for PCT/US14/29805, filed Mar. 14, 2014 (Applicant—Pioneer Hi-Bred International, Inc.) (11 pages).
GenBank CN497524.1. B12_01530.AB1 Diabrotica virgifera virgifera midguts eDNA, rnRNA sequence. (2011). [Retrieved from the Internet Oct. 18, 2014: http://www.ncbi.nlm.nih.gov/nucesU62238840?report=genbank&sat=1&satkey=22746061] (1 page).
Baum et al, "Control of coleopteran insect pests through RNA interference," Nature Biotechnology, vol. 25 No. 11, (Nov. 1997), pp. 1322-1326 and 1 page of Supplementary Tables and 15 pages of Supplementary Figures.
International Search Report for International Application No. PCT/US2010/046762 completed Nov. 9, 2010.
International Search Report and Written Opinion for International Application No. PCT/US2010/046762 completed Jan. 20, 2011.
Izumi et al, "A novel protein complex, Mesh-Ssk, is required for septate junction formation in the *Drosophila* midgut", Journal of Cell Science, vol. 125:492-4933 (2012).
Yanagihashi et al, "Snakeskin, a membrane protein associated with smooth septate junctions, is required for intestinal barrier function in *Drosophila*", Journal of Cell Science, vol. 125:1980-1990 (2012).

(Continued)

*Primary Examiner* — Stephen Uyeno

(57) ABSTRACT

Methods and compositions are provided which employ a silencing element that, when ingested by a pest, such as a Coleopteran plant pest or a *Diabrotica* plant pest, decrease the expression of a target sequence in the pest. In specific embodiments, the decrease in expression of the target sequence controls the pest and thereby the methods and compositions are capable of limiting damage to a plant. The present invention provides various target polynucleotides set forth in any one of SEQ ID NOS: disclosed herein, (but not including the forward and reverse primers.) or active variants and fragments thereof, or complements thereof, wherein a decrease in expression of one or more of the sequences in the target pest controls the pest (i.e., has insecticidal activity). Further provided are silencing elements which when ingested by the pest decrease the level of the target polypeptide and thereby control the pest. In specific embodiments, the pest is *D. virgifera virgifera, D. barberi, D. virgifera zeae, D. speciosa, D. speciosa, or D. undecimpunctata howardi*. Plants, plant parts, bacteria and other host cells comprising the silencing elements or an active variant or fragment thereof of the invention are also provided.

43 Claims, 30 Drawing Sheets

(56) References Cited

OTHER PUBLICATIONS

Siegfried et al., "Expressed sequence tags from Diabrotica virgifera virgifera midgut identify a coleopteran cadherin and a diversity of cathepsins", Insect Molecular Biology, (2005) 14(2):137-143.

* cited by examiner

FIG. 1A

Table 1A

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| idv1c.pk037.j20.f | hypothetical protein | DV-HP2-FIS | Seq No.001 | Seq No.002 | Seq No.003 | 593 | 3 |
| idv1c.pk032.n18.f:fis | RNA-dependent DNA polymerase | DV-POL-FIS | Seq No.005 | Seq No.006 | Seq No.007 | 446 | 1.5 |
| idv1c.pk034.k22.f:fis | hypothetical protein TcasGA2_TC013063 [Tribolium castaneum] | DV-RNAPOL-FIS | Seq No.009 | Seq No.010 | Seq No.011 | 445 | 2.6 |
| iwc1c.pk017.e6 | Small GTPase superfamily, Rab 11 | | Seq No.013 | Seq No.014 | Seq No.015 | 563 | 2.9 |
| iwc1c.pk019.o21 | protein transport protein sec23 | DV-PTP-FIS | Seq No.017 | Seq No.018 | Seq No.019 | 204 | 2.125 |
| iwc1c.pk023.f12 | putative elongation factor 1-alp | | Seq No.021 | Seq No.022 | Seq No.023 | 599 | 1.5 |
| iwc1c.pk026.d3 | Vacuolar protein sorting-associated, VPS28 | | Seq No.025 | Seq No.026 | Seq No.027 | 550 | 2.9 |
| iwc1c.pk026.e6 | chaperonin subunit 6a zeta | | Seq No.029 | Seq No.030 | Seq No.031 | 578 | 2.3 |
| iwc1c.pk026.f16 | nuclear lamin C protein | | Seq No.033 | Seq No.034 | Seq No.035 | 709 | 1.7 |
| iwc1c.pk026.h16 | chaperonin | DV-CPNN-FIS | Seq No.037 | Seq No.038 | Seq No.039 | 635 | 1.8 |
| iwc1c.pk027.i21 | V-ATPase B subunit | | Seq No.041 | Seq No.042 | Seq No.043 | 579 | 3.0 |
| iwc1c.pk029.h21 | translation elongation factor 2 | DV-TEF2-FIS | Seq No.045 | Seq No.046 | Seq No.047 | 670 | 2.4 |
| iwm2c.pk004.m2 | signal recognition particle 54 kda protein | DV-SRP54-FIS | Seq No.049 | Seq No.050 | Seq No.051 | 528 | 2.6 |
| iwm2c.pk005.j8 | CG3612-PA isoform 2 [Tribolium castaneum] | | Seq No.053 | Seq No.054 | Seq No.055 | 605 | 1.5 |
| iwm2c.pk005.l7 | chaperonin | | Seq No.057 | Seq No.058 | Seq No.059 | 583 | 2.3 |
| iwm2c.pk008.e24 | translation initiation factor 3 | DV-TIF3-FIS | Seq No.061 | Seq No.062 | Seq No.063 | 588 | 2.5 |
| idv1c.pk015.b8.f:fis | GTP-binding protein SAR2 | DV-BPSAR2-FIS | Seq No.065 | Seq No.066 | Seq No.067 | 716 | 3 |
| idv1c.pk019.h19.f | homocysteine S-methyltransferase | | Seq No.069 | Seq No.070 | Seq No.071 | 619 | 2.125 |

FIG. 1B

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| idv1c.pk019.h19.f | homocysteine S-methyltransferase | | Seq No.069 | Seq No.070 | Seq No.071 | 619 | 2.125 |
| idv1c.pk024.n1.f:fis | Transcription elongation factor SPT6-like protein | | Seq No.073 | Seq No.074 | Seq No.075 | 680 | 2.8 |
| idv1c.pk026.d10.f | Nucleosome Core, Chain C | DV-HP1-FIS | Seq No.077 | Seq No.078 | Seq No.079 | 319 | 2.625 |
| idv1c.pk033.j21.f:fis | Proteasome subunit alpha type-6-like protein | | Seq No.081 | Seq No.082 | Seq No.083 | 759 | 1.625 |
| idv1c.pk037.j14.f | Ras-like GTP-binding protein Rho1 | DV-RASRHO-FIS | Seq No.085 | Seq No.086 | Seq No.087 | 587 | 2.625 |
| iwmlbpc.pk023.i12.f | DNA-directed RNA polymerase II 13.3 kDa polypeptide | | Seq No.089 | Seq No.090 | Seq No.091 | 444 | 2 |
| idv1c.pk037.n13.f | Small GTPase superfamily, Ras type protein | | Seq No.093 | Seq No.094 | Seq No.095 | 453 | 2.125 |
| idv1c.pk038.b24.f | GTP-binding nuclear protein Ran | | Seq No.097 | Seq No.098 | Seq No.099 | 601 | 2.25 |
| idv1c.pk038.d14.f | DEAD box ATP-dependent RNA helicase | DV-DEAD-FIS | Seq No.101 | Seq No.102 | Seq No.103 | 614 | 2.625 |
| idv1c.pk038.k10.f | ribosome-associated protein P40 | | Seq No.105 | Seq No.106 | Seq No.107 | 683 | 1.9 |
| idv1c.pk038.p10.f | Arrest defective 1 | | Seq No.109 | Seq No.110 | Seq No.111 | 559 | 1.75 |
| idv1c.pk040.c10.f | Nuclear transport factor 2 (NTF2) domain protein | DV-HPP15-FIS | Seq No.113 | Seq No.114 | Seq No.115 | 368 | 2.6 |
| idv1c.pk040.j22.f | eukaryotic translation initiation factor | | Seq No.117 | Seq No.118 | Seq No.119 | 589 | 2.25 |
| idv1c.pk041.n22.f | Myosin heavy chain CG17927-PF isoform 1 [Tribolium castaneum] | | Seq No.121 | Seq No.122 | Seq No.123 | 610 | 1.75 |
| idv1c.pk042.g10.f | eukaryotic translation initiation factors | | Seq No.125 | Seq No.126 | Seq No.127 | 628 | 2 |
| idv1c.pk042.i20.f | AP-1 complex subunit mu-1-like isoform 1 | DV-CAP-FIS | Seq No.129 | Seq No.130 | Seq No.131 | 619 | 2.13 |

FIG. 1C

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| idv1c.pk043.o11.f | Paramyosin, long form-like | | Seq No.133 | Seq No.134 | Seq No.135 | 660 | 2.125 |
| idv1c.pk002.j17.f:fis | proteasome 26S subunit, alpha type, 3 | DV-PAT3-FIS | Seq No.137 | Seq No.138 | Seq No.139 | 589 | 2.43 |
| idv1c.pk003.d6.f:fis | proteasome 26S subunit, beta type, 1 | DV-PROTB-FIS | Seq No.141 | Seq No.142 | Seq No.143 | 577 | 2.25 |
| idv1c.pk016.h19.f:fis | proteasome 26S subunit, beta type, 6 [9] | DV-PBT6-FIS | Seq No.145 | Seq No.146 | Seq No.147 | 542 | 2.63 |
| idv1c.pk025.a4.f:fis | proteasome 26S subunit, non-ATPase, 3 | DV-NATP3-FIS | Seq No.149 | Seq No.150 | Seq No.151 | 559 | 2.63 |
| idv1c.pk033.j21.f:fis | proteasome 26S subunit, alpha type, 6 | DV-PAT6-FIS | Seq No.153 | Seq No.154 | Seq No.155 | 473 | 1.50 |
| idv1c.pk040.m14.f | proteasome 26S subunit, beta type, 3 | DV-BETA3-FIS | Seq No.157 | Seq No.158 | Seq No.159 | 451 | 2.8 |
| idv1c.pk046.m13.f | proteasome 26S subunit, non-ATPase, 14 | DV-NATP14-FIS | Seq No.161 | Seq No.162 | Seq No.163 | 530 | 2.13 |
| idv1c.pk047.d23.f | proteasome 26S subunit, alpha type, 1 | | Seq No.165 | Seq No.166 | Seq No.167 | 654 | 2.50 |
| idv1c.pk047.i11.f | proteasome 26S subunit, beta type, 7 [10] | DV-BETA7-FIS | Seq No.169 | Seq No.170 | Seq No.171 | 558 | 2.00 |
| idv1c.pk053.i16.f | proteasome 26S subunit, non-ATPase, 7 | DV-NATP7-FIS | Seq No.173 | Seq No.174 | Seq No.175 | 473 | 2.25 |
| idv1c.pk062.i5.f | proteasome 26S subunit, beta type, 4 | DV-BETA4-FIS | Seq No.177 | Seq No.178 | Seq No.179 | 553 | 2.50 |
| inv1c.pk010.o11.f | proteasome 26S subunit, non-ATPase, 8 | DV-NATP8-FIS | Seq No.181 | Seq No.182 | Seq No.183 | 420 | 2.50 |
| inv1c.pk011.c3.f | proteasome 26S subunit, beta type, 2 | DV-BETA2-FIS | Seq No.185 | Seq No.186 | Seq No.187 | 716 | 2.38 |
| iwc1c.pk003.n19 | proteasome 26S subunit, non-ATPase, 2 | DV-NATP2-FIS | Seq No.189 | Seq No.190 | Seq No.191 | 364 | 2.13 |
| iwc1c.pk013.f20 | proteasome 26S subunit, non-ATPase, 13 | | Seq No.193 | Seq No.194 | Seq No.195 | 358 | 1.83 |
| iwc1c.pk018.g3 | proteasome 26S subunit, ATPase, 1 | | Seq No.197 | Seq No.198 | Seq No.199 | 410 | 2.00 |
| iwc1c.pk018.n9 | proteasome 26S subunit, alpha type, 4 | | Seq No.201 | Seq No.202 | Seq No.203 | 458 | 2.50 |
| iwc1c.pk022.l6 | proteasome 26S subunit, ATPase, 5 | DV-ATP5-FIS | Seq No.205 | Seq No.206 | Seq No.207 | 453 | 2.00 |

FIG. 1D

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| iwc1c.pk023.h8 | proteasome 26S subunit, ATPase, 2 | | Seq No.209 | Seq No.210 | Seq No.211 | 488 | 2.00 |
| iwc1c.pk028.o15 | proteasome 26S subunit, non-ATPase, 11 | | Seq No.213 | Seq No.214 | Seq No.215 | 553 | 2.38 |
| iwc1s.pk003.m17 | proteasome 26S subunit, alpha type, 5 | DV-PAT5-FIS | Seq No.217 | Seq No.218 | Seq No.219 | 469 | 2.38 |
| iwm2c.pk009.t12 | proteasome 26S subunit, ATPase, 4 | | Seq No.221 | Seq No.222 | Seq No.223 | 404 | 1.75 |
| iwm2s.pk015.k15 | proteasome 26S subunit, non-ATPase, 1 | DV-NATP1-FIS | Seq No.225 | Seq No.226 | Seq No.227 | 455 | 2.25 |
| 454run3_isotig09801 | Eukaryotic initiation factor 4A-like | | Seq No.229 | Seq No.230 | Seq No.231 | 701 | 1.63 |
| idv1c.pk044.p3.f | Eukaryotic initiation factor 4A-like | | Seq No.233 | Seq No.234 | Seq No.235 | 669 | 1.5 |
| idv1c.pk045.e5.f | Dosage compensation regulator maleless | | Seq No.237 | Seq No.238 | Seq No.239 | 628 | 2.25 |
| idv1c.pk045.h1.f | Phosphatidylinositol transfer protein alpha isoform-like protein | | Seq No.241 | Seq No.242 | Seq No.243 | 610 | 1.625 |
| idv1c.pk046.p17.f | small GTP binding protein RAB5 | | Seq No.245 | Seq No.246 | Seq No.247 | 524 | 2.375 |
| idv1c.pk047.d23.f | proteasome subunit alpha | | Seq No.249 | Seq No.250 | Seq No.251 | 529 | 2.375 |
| idv1c.pk047.h18.f | Tetratricopeptide repeat protein 14-like | | Seq No.253 | Seq No.254 | Seq No.255 | 533 | 2 |
| idv1c.pk048.c22.f | mitochondrial cytochrome c1 [Tribolium castaneum] | | Seq No.257 | Seq No.258 | Seq No.259 | 583 | 1.25 |
| idv1c.pk048.c22.f | ubiquitin-activating enzyme E1 [Tribolium castaneum] | | Seq No.261 | Seq No.262 | Seq No.263 | 546 | 2 |
| idv1c.pk049.a20.f | Schizophyllum commune mitochondrial DNA, complete genome | | Seq No.265 | Seq No.266 | Seq No.267 | 644 | 2 |
| idv1c.pk049.b13.f | no significant hits | | Seq No.269 | Seq No.270 | Seq No.271 | 629 | 1.5 |
| idv1c.pk049.b16.f | Gelsolin repeat protein | | Seq No.273 | Seq No.274 | Seq No.275 | 700 | 2 |

FIG. 1E

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| idv1c.pk049.b17.f | Glutathione S-transferase/chloride channel, C-terminal protein | | Seq No.277 | Seq No.278 | Seq No.279 | 608 | 2 |
| idv1c.pk049.i4.f | WD domain, G-beta repeat protein | | Seq No.281 | Seq No.282 | Seq No.283 | 724 | 1.25 |
| idv1c.pk049.m20.f | Zinc finger, DHHC-type, palmitoyltransferase | | Seq No.285 | Seq No.286 | Seq No.287 | 501 | 1.625 |
| idv1c.pk050.a13.f | Glutamate receptor, ionotropic ampa, subunit 1, 2, 3, 4 | | Seq No.289 | Seq No.290 | Seq No.291 | 628 | 2 |
| idv1c.pk050.b3.f | Myosin binding subunit CG32156-PG [Tribolium castaneum] | | Seq No.293 | Seq No.294 | Seq No.295 | 710 | 2 |
| idv1c.pk053.p12.f | S5e ribosomal protein [Timarcha balearica] | | Seq No.297 | Seq No.298 | Seq No.299 | 632 | 2 |
| idv1c.pk054.k12.f | ribosomal protein L9e [Cicindela littorea] | | Seq No.301 | Seq No.302 | Seq No.303 | 546 | 2.125 |
| idv1c.pk057.e11.f | eukaryotic translation initiation factor 2 gamma subunit | | Seq No.305 | Seq No.306 | Seq No.307 | 409 | 1.5 |
| idv1c.pk057.h7.f | heat shock protein 70 | | Seq No.309 | Seq No.310 | Seq No.311 | 670 | 2.375 |
| idv1c.pk057.n10.f | V-type proton ATPase subunit B | | Seq No.313 | Seq No.314 | Seq No.315 | 672 | 2 |
| idv1c.pk058.b17.f | Calmodulin 1 (phosphorylase kinase, delta) | | Seq No.317 | Seq No.318 | Seq No.319 | 500 | 2.25 |
| idv1c.pk058.i15.f | coatomer subunit beta [Tribolium castaneum] | | Seq No.321 | Seq No.322 | Seq No.323 | 514 | 2.125 |
| idv1c.pk058.p1.f | heat shock cognate 70 | | Seq No.325 | Seq No.326 | Seq No.327 | 606 | 2.25 |
| idv1c.pk055.m8.f | Small GTPase superfamily, Ras type protein | | Seq No.329 | Seq No.330 | Seq No.331 | 718 | 2.25 |
| idv1c.pk060.g1.f | Homo sapiens PAC clone RP5-1007H16 from 7 | | Seq No.333 | Seq No.334 | Seq No.335 | 704 | 2 |

FIG. 1F

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| idv1c.pk060.g5.f | RNA-dependent DNA polymerase | | Seq No.337 | Seq No.338 | Seq No.339 | 221 | 2.25 |
| idv1c.pk062.o19 | proteasome subunit alpha type 2 | | Seq No.341 | Seq No.342 | Seq No.343 | 656 | 2 |
| idv3c.pk001.a13.f | acidic p0 ribosomal protein | | Seq No.345 | Seq No.346 | Seq No.347 | 512 | 1.85 |
| idv1c.pk062.d24.f | similar to serine palmitoyltransferase | | Seq No.349 | Seq No.350 | Seq No.351 | 700 | 1.5 |
| idv3c.pk007.i8.f | Cytoplasmic actin | | Seq No.353 | Seq No.354 | Seq No.355 | 440 | 2.25 |
| idv3c.pk008.h22.f | H+-ATPase V-type subunit | | Seq No.357 | Seq No.358 | Seq No.359 | 600 | 2.125 |
| idv3c.pk011.g2.f | similar to ribosomal protein L14 | | Seq No.361 | Seq No.362 | Seq No.363 | 525 | 2 |
| idv3c.pk012.e23.f | similar to CG32019-PA [Tribolium castaneum] | | Seq No.365 | Seq No.366 | Seq No.367 | 551 | 2 |
| idv3c.pk013.g12.f | ubiquitin/ribosomal protein S27Ae fusion protein | | Seq No.369 | Seq No.370 | Seq No.371 | 586 | 2 |
| idv3c.pk016.a10.f | actin-depolymerizing factor 1 [Bombyx mori] | | Seq No.373 | Seq No.374 | Seq No.375 | 611 | 2.125 |
| idv3c.pk016.g12.f | putative ribosomal protein L17/23 [Diaphorina citri] | | Seq No.377 | Seq No.378 | Seq No.379 | 357 | 2.125 |
| idv3c.pk016.l10.f | Polyadenylate-binding protein | | Seq No.381 | Seq No.382 | Seq No.383 | 520 | 1.75 |
| idv3c.pk026.f22.f | MLE protein [Bombyx mori] | | Seq No.385 | Seq No.386 | Seq No.387 | 490 | 1.625 |
| iwmhipc.pk001.d23.f | actin | | Seq No.389 | Seq No.390 | Seq No.391 | 658 | 2.625 |
| iwmhipc.pk001.d24.f | unknown | | Seq No.393 | Seq No.394 | Seq No.395 | 601 | 1.75 |
| iwmhipc.pk003.i17.f | transport protein Sec61 subunit alpha 2 | | Seq No.397 | Seq No.398 | Seq No.399 | 600 | 2 |
| iwmhipc.pk006.g5.f | ribosomal protein L6 | | Seq No.401 | Seq No.402 | Seq No.403 | 707 | 2.125 |
| iwmhipc.pk005.i16.f | ribosomal protein S6 kinase beta-1-like isoform 1 | | Seq No.405 | Seq No.406 | Seq No.407 | 671 | 2.25 |

FIG. 1G

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| iwmhipc.pk003.o14.f | S5e ribosomal protein | | Seq No.409 | Seq No.410 | Seq No.411 | 612 | 2.125 |
| iwmhipc.pk004.b8.f | ribosomal protein L15e | | Seq No.413 | Seq No.414 | Seq No.415 | 630 | 1.75 |
| iwmhipc.pk004.d7.f | ribosomal protein L10e | | Seq No.417 | Seq No.418 | Seq No.419 | 663 | 2 |
| iwmhipc.pk006.o23.f | ribosomal protein L10Ae | | Seq No.421 | Seq No.422 | Seq No.423 | 625 | 1.75 |
| iwmhipc.pk011.g12.f | UPF0464 protein C15orf44 homolog [Nasonia vitripennis] | | Seq No.425 | Seq No.426 | Seq No.427 | 693 | 2 |
| iwmhipc.pk011.i2.f | Heat shock protein DnaJ | | Seq No.429 | Seq No.430 | Seq No.431 | 651 | 1.875 |
| iwmhipc.pk011.j6.f | nubbin [Tribolium castaneum] | | Seq No.433 | Seq No.434 | Seq No.435 | 658 | 1.75 |
| iwmhipc.pk011.j4.f | Conserved oligomeric Golgi complex, subunit 6 | | Seq No.437 | Seq No.438 | Seq No.439 | 647 | 1.625 |
| iwmhipc.pk011.l17.f | Peptidase C2, calpain, large subunit | | Seq No.441 | Seq No.442 | Seq No.443 | 711 | 1.625 |
| iwmhipc.pk023.f4.f | cadherin-like gene | | Seq No.445 | Seq No.446 | Seq No.447 | 579 | 2 |
| iwmhipc.pk023.k22.f | Acetyl-coa acetyltransferase | | Seq No.449 | Seq No.450 | Seq No.451 | 539 | 2.875 |
| iwmhipc.pk023.l2.f | Cordon-bleu protein-like 1 | | Seq No.453 | Seq No.454 | Seq No.455 | 603 | 2 |
| iwmhipc.pk023.l22.f | Prohibitin protein | | Seq No.457 | Seq No.458 | Seq No.459 | 519 | 2.125 |
| iwmhipc.pk026.a10.f | Multisynthetase complex, auxiliary protein | | Seq No.461 | Seq No.462 | Seq No.463 | 602 | 2.625 |
| iwmhipc.pk026.m2.f | KN motif and ankyrin repeat domain-containing protein 1-like protein | | Seq No.465 | Seq No.466 | Seq No.467 | 508 | 2 |
| iwmhipc.pk030.p16 | ubiquitin B | | Seq No.469 | Seq No.470 | Seq No.471 | 525 | 3 |
| iwmhipc.pk030.l7.f | eukaryotic release factor 1 CG5605-PA | | Seq No.473 | Seq No.474 | Seq No.475 | 653 | 2 |

FIG. 1H

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| iwmhipc.pk028.c16.f | vacuolar ATPase subunit C | | Seq No.477 | Seq No.478 | Seq No.479 | 577 | 1.875 |
| iwmhipc.pk031.d11.f | ribosomal protein L7 | | Seq No.481 | Seq No.482 | Seq No.483 | 689 | 1.875 |
| iwmhipc.pk031.j10.f | V-type proton ATPase subunit e-like protein | | Seq No.485 | Seq No.486 | Seq No.487 | 327 | 2 |
| iwmhipc.pk032.j18.f | skd/vacuolar sorting | | Seq No.489 | Seq No.490 | Seq No.491 | 526 | 2 |
| iwmhipc.pk034.h8.f | Vacuolar proton pump subunit H | | Seq No.493 | Seq No.494 | Seq No.495 | 621 | 2 |
| iwmhipc.pk034.i20.f | Eukaryotic translation initiation factor 3 subunit G-like protein | | Seq No.497 | Seq No.498 | Seq No.499 | 642 | 2 |
| iwmhipc.pk036.f24.f | Coatomer protein complex subunit delta | | Seq No.501 | Seq No.502 | Seq No.503 | 524 | 2.65 |
| iwmhipc.pk039.j12.f | eukaryotic translation initiation factor 3 subunit C-like | | Seq No.505 | Seq No.506 | Seq No.507 | 612 | 1.875 |
| iwmhipc.pk039.k19.f | Cytochrome P450 CYP9Z1 (Cyp9z1) | | Seq No.509 | Seq No.510 | Seq No.511 | 503 | 1.875 |
| iwmhipc.pk040.n14.f | ribosomal protein S23-like protein | | Seq No.513 | Seq No.514 | Seq No.515 | 502 | 2 |
| iwmhipc.pk041.n17.f | Eukaryotic translation initiation factor 3 subunit 9 | | Seq No.517 | Seq No.518 | Seq No.519 | 719 | 2 |
| iwmhipc.pk052.j3.f | ATP synthase alpha subunit vacuolar | | Seq No.521 | Seq No.522 | Seq No.523 | 639 | 2 |
| iwmlopc.pk002.f13.f | ribosomal protein L21 | | Seq No.525 | Seq No.526 | Seq No.527 | 507 | 2.125 |
| iwmlopc.pk031.c23.f | ribosomal protein | | Seq No.529 | Seq No.530 | Seq No.531 | 519 | 2 |
| iwmlopc.pk038.m15.f | ATP synthase, H+ transporting, mitochondrial F1 complex, delta subunit | | Seq No.533 | Seq No.534 | Seq No.535 | 600 | 2.25 |
| iwmlopc.pk042.g3.f | unknown | | Seq No.537 | Seq No.538 | Seq No.539 | 612 | 1.875 |
| iwmlopc.pk006.g13.f | 60S ribosomal protein L23a-like | | Seq No.541 | Seq No.542 | Seq No.543 | 558 | 2.25 |
| iwmlopc.pk006.g16.f | ribosomal protein L18e | | Seq No.545 | Seq No.546 | Seq No.547 | 544 | 2 |

FIG. 1l

| cDNA ID | GENE ID | Target Name | Seq No. (RNAi target) | Seq No. (PCR forward primer) | Seq No. (PCR reverse primer) | RNA Length | Primary Score |
|---|---|---|---|---|---|---|---|
| iwmlopc.pk007.g1.f | ribosomal protein L35A | | Seq No.549 | Seq No.550 | Seq No.551 | 401 | 2 |
| iwmlopc.pk015.h20.f | ribosomal protein L12e | | Seq No.553 | Seq No.554 | Seq No.555 | 542 | 2 |
| iwmlopc.pk022.p14.f | ribosomal protein S11 | | Seq No.557 | Seq No.558 | Seq No.559 | 450 | 2 |

FIG. 1J

Table 1B

| cDNA ID | GENE ID | Target Name | Seq No. (WCRW transcript sequences) | Transcript ID | Length |
|---|---|---|---|---|---|
| idv1c.pk037.j20.f | hypothetical protein | DV-HP2-FIS | Seq No.004 | ta01240.010_diavv | 5689 |
| idv1c.pk032.n18.f:fis | RNA-dependent DNA polymerase | DV-POL-FIS | Seq No.008 | ta01405.001_diavv | 7388 |
| idv1c.pk034.k22.f:fis | hypothetical protein TcasGA2_TC013063 [Tribolium castaneum] | DV-RNAPOL-FIS | Seq No.012 | ta02059.001_diavv | 544 |
| iwc1c.pk017.e6 | Small GTPase superfamily, Rab 11 | | Seq No.016 | ta47051.001_diavv | 689 |
| iwc1c.pk019.o21 | protein transport protein sec23 | DV-PTP-FIS | Seq No.020 | ta01733.001_diavv | 2636 |
| iwc1c.pk023.f12 | putative elongation factor 1-alp | | Seq No.024 | ta04714.004_diavv | 1698 |
| iwc1c.pk026.d3 | Vacuolar protein sorting-associated, VPS28 | | Seq No.028 | ta01620.001_diavv | 769 |
| iwc1c.pk026.e6 | chaperonin subunit 6a zeta | | Seq No.032 | ta00896.001_diavv | 1864 |
| iwc1c.pk026.f16 | nuclear lamin C protein | | Seq No.036 | ta03354.001_diavv | 2662 |
| iwc1c.pk026.h16 | chaperonin | DV-CPNN-FIS | Seq No.040 | ta04788.001_diavv | 1866 |
| iwc1c.pk027.i21 | V-ATPase B subunit | | Seq No.044 | ta00620.009_diavv | 2471 |
| iwc1c.pk029.h21 | translation elongation factor 2 | DV-TEF2-FIS | Seq No.048 | ta02030.005_diavv | 4535 |
| iwm2c.pk004.m2 | signal recognition particle 54 kda protein | DV-SRP54-FIS | Seq No.052 | ta05283.001_diavv | 1927 |
| iwm2c.pk005.i8 | CG3612-PA isoform 2 [Tribolium castaneum] | | Seq No.056 | ta00263.005_diavv | 2003 |
| iwm2c.pk005.l7 | chaperonin | | Seq No.060 | ta05506.001_diavv | 1889 |
| iwm2c.pk008.e24 | translation initiation factor 3 | DV-TIF3-FIS | Seq No.064 | ta05000.002_diavv | 3734 |
| idv1c.pk015.b8.f:fis | GTP-binding protein SAR2 | DV-BPSAR2-FIS | Seq No.068 | ta00303.001_diavv | 2438 |
| idv1c.pk019.h19.f | homocysteine S-methyltransferase | | Seq No.072 | ta08045.004_diavv | 1246 |
| idv1c.pk024.n1.f:fis | Transcription elongation factor SPT6-like protein | | Seq No.076 | ta02840.001_diavv | 6054 |
| idv1c.pk026.d10.f | Nucleosome Core, Chain C | DV-HP1-FIS | Seq No.080 | ta07804.001_diavv | 456 |
| idv1c.pk033.j21.f:fis | Proteasome subunit alpha type-6-like protein | | Seq No.084 | ta04410.001_diavv | 957 |
| idv1c.pk037.j14.f | Ras-like GTP-binding protein Rho1 | DV-RASRHO-FIS | Seq No.088 | ta15897.001_diavv | 1530 |
| iwmlopc.pk023.i12.f | DNA-directed RNA polymerase II 13.3 kDa polypeptide | | Seq No.092 | ta06570.001_diavv | 575 |

FIG. 1K

| cDNA ID | GENE ID | Target Name | Seq No. (WCRW transcript sequences) | Transcript ID | Length |
|---|---|---|---|---|---|
| idv1c.pk037.n13.f | Small GTPase superfamily, Ras type protein | | Seq No.096 | ta40942.001_diavv | 640 |
| idv1c.pk038.b24.f | GTP-binding nuclear protein Ran | | Seq No.100 | ta05966.001_diavv | 1075 |
| idv1c.pk038.d14.f | DEAD box ATP-dependent RNA helicase | DV-DEAD-FIS | Seq No.104 | ta03347.002_diavv | 1515 |
| idv1c.pk038.k10.f | ribosome-associated protein P40 | | Seq No.108 | ta15911.001_diavv | 822 |
| idv1c.pk038.p10.f | Arrest defective 1 | | Seq No.112 | ta05802.003_diavv | 903 |
| idv1c.pk040.c10.f | Nuclear transport factor 2 (NTF2) domain protein | DV-HPP15-FIS | Seq No.116 | ta08838.001_diavv | 470 |
| idv1c.pk040.j22.f | eukaryotic translation initiation factor | | Seq No.120 | ta00006.001_diavv | 1418 |
| idv1c.pk041.n22.f | Myosin heavy chain CG17927-PF isoform 1 [Tribolium castaneum] | | Seq No.124 | ta41130.001_diavv | 669 |
| idv1c.pk042.g10.f | eukaryotic translation initiation factors | | Seq No.128 | ta05495.001_diavv | 1547 |
| idv1c.pk042.i20.f | AP-1 complex subunit mu-1-like isoform 1 | DV-CAP-FIS | Seq No.132 | ta08478.001_diavv | 2131 |
| idv1c.pk043.o11.f | Paramyosin, long form-like | | Seq No.136 | ta00254.002_diavv | 3369 |
| idv1c.pk002.j17.f:fis | proteasome 26S subunit, alpha type, 3 | DV-PAT3-FIS | Seq No.140 | ta06609.001_diavv | 956 |
| idv1c.pk003.d6.f:fis | proteasome 26S subunit, beta type, 1 | DV-PROTB-FIS | Seq No.144 | ta03835.001_diavv | 913 |
| idv1c.pk016.h19.f:fis | proteasome 26S subunit, beta type, 6 [9] | DV-PBT6-FIS | Seq No.148 | ta02145.001_diavv | 850 |
| idv1c.pk025.a4.f:fis | proteasome 26S subunit, non-ATPase. 3 | DV-NATP3-FIS | Seq No.152 | ta08208.001_diavv | 1711 |
| idv1c.pk033.j21.f:fis | proteasome 26S subunit, alpha type, 6 | DV-PAT6-FIS | Seq No.156 | 454run3_isotig15710 | 879 |
| idv1c.pk040.m14.f | proteasome 26S subunit, beta type, 3 | DV-BETA3-FIS | Seq No.160 | ta03399.001_diavv | 829 |
| idv1c.pk046.m13.f | proteasome 26S subunit, non-ATPase. 14 | DV-NATP14-FIS | Seq No.164 | ta04924.001_diavv | 1190 |
| idv1c.pk047.d23.f | proteasome 26S subunit, alpha type, 1 | | Seq No.168 | ta04466.001_diavv | 1142 |
| idv1c.pk047.j11.f | proteasome 26S subunit, beta type, 7 [10] | DV-BETA7-FIS | Seq No.172 | ta04816.001_diavv | 1578 |
| idv1c.pk053.l16.f | proteasome 26S subunit, non-ATPase. 7 | DV-NATP7-FIS | Seq No.176 | ta03894.001_diavv | 1221 |
| idv1c.pk062.l5.f | proteasome 26S subunit, beta type, 4 | DV-BETA4-FIS | Seq No.180 | ta01874.001_diavv | 925 |
| idv1c.pk010.o11.f | proteasome 26S subunit, non-ATPase. 8 | DV-NATP8-FIS | Seq No.184 | ta06150.001_diavv | 1040 |
| irw1c.pk011.c3.f | proteasome 26S subunit, beta type, 2 | DV-BETA2-FIS | Seq No.188 | ta01941.001_diavv | 872 |
| iwc1c.pk003.n19 | proteasome 26S subunit, non-ATPase. 2 | DV-NATP2-FIS | Seq No.192 | ta44362.001_diavv | 3066 |

FIG. 1L

| cDNA ID | GENE ID | Target Name | Seq No. (WCRW transcript sequences) | Transcript ID | Length |
|---|---|---|---|---|---|
| iwc1c.pk013.f20 | proteasome 26S subunit, non-ATPase, 13 | | Seq No.196 | ta04679.001_diavv | 1241 |
| iwc1c.pk018.g3 | proteasome 26S subunit, ATPase, 1 | | Seq No.200 | ta07921.001_diavv | 1452 |
| iwc1c.pk018.n9 | proteasome 26S subunit, alpha type, 4 | | Seq No.204 | ta04612.001_diavv | 892 |
| iwc1c.pk022.i6 | proteasome 26S subunit, ATPase, 5 | DV-ATP5-FIS | Seq No.208 | ta01297.001_diavv | 1322 |
| iwc1c.pk023.h8 | proteasome 26S subunit, ATPase, 2 | | Seq No.212 | 454run3_isotig16670 | 1425 |
| iwc1c.pk028.o15 | proteasome 26S subunit, non-ATPase, 11 | | Seq No.216 | ta03917.001_diavv | 1860 |
| iwc1s.pk003.m17 | proteasome 26S subunit, alpha type, 5 | DV-PAT5-FIS | Seq No.220 | ta09615.001_diavv | 850 |
| iwm2c.pk009.f12 | proteasome 26S subunit, ATPase, 4 | | Seq No.224 | ta03370.001_diavv | 1364 |
| iwm2s.pk015.k15 | proteasome 26S subunit, non-ATPase, 1 | DV-NATP1-FIS | Seq No.228 | ta00483.001_diavv | 3242 |
| 454run3_isotig09801 | Eukaryotic initiation factor 4A-like | | Seq No.232 | ta03651.003_diavv | 2338 |
| idv1c.pk044.p3.f | Eukaryotic initiation factor 4A-like | | Seq No.236 | 454run12_isotig05267 | 1764 |
| idv1c.pk045.e5.f | Dosage compensation regulator maleless | | Seq No.240 | ta41281.001_diavv | 697 |
| idv1c.pk045.h1.f | Phosphatidylinositol transfer protein alpha isoform-like protein | | Seq No.244 | ta20868.001_diavv | 800 |
| idv1c.pk046.p17.f | small GTP binding protein RAB5 | | Seq No.248 | ta01834.005_diavv | 3182 |
| idv1c.pk047.d23.f | proteasome subunit alpha | | Seq No.252 | 454run3_isotig10716 | 1051 |
| idv1c.pk047.h18.f | Tetratricopeptide repeat protein 14-like | | Seq No.256 | ta01498.002_diavv | 3832 |
| idv1c.pk048.a20.f | mitochondrial cytochrome c1 [Tribolium castaneum] | | Seq No.260 | ta01835.001_diavv | 1332 |
| idv1c.pk048.c22.f | ubiquitin-activating enzyme E1 [Tribolium castaneum] | | Seq No.264 | ta05794.001_diavv | 4199 |
| idv1c.pk049.a20.f | Schizophyllum commune mitochondrial DNA, complete genome | | Seq No.268 | ta41459.001_diavv | 712 |
| idv1c.pk049.b13.f | no significant hits | | Seq No.272 | ta03339.001_diavv | 1750 |
| idv1c.pk049.b16.f | Gelsolin repeat protein | | Seq No.276 | ta00090.001_diavv | 2169 |
| idv1c.pk049.b17.f | Glutathione S-transferase/chloride channel, C-terminal protein | | Seq No.280 | ta20625.001_diavv | 1508 |
| idv1c.pk049.i4.f | WD domain, G-beta repeat protein | | Seq No.284 | ta06970.001_diavv | 1151 |

FIG. 1M

| cDNA ID | GENE ID | Target Name | Seq No. (WCRW transcript sequences) | Transcript ID | Length |
|---|---|---|---|---|---|
| idv1c.pk049.m20.f | Zinc finger, DHHC-type, palmitoyltransferase | | Seq No.288 | ta06058.001_diavv | 2197 |
| idv1c.pk050.a13.f | Glutamate receptor, ionotropic ampa, subunit 1, 2, 3, 4 | | Seq No.292 | ta41486.001_diavv | 690 |
| idv1c.pk050.b3.f | Myosin binding subunit CG32156-PG [Tribolium castaneum] | | Seq No.296 | ta00860.008_diavv | 3435 |
| idv1c.pk053.p12.f | S5e ribosomal protein [Timarcha balearica] | | Seq No.300 | ta21523.001_diavv | 806 |
| idv1c.pk054.k12.f | ribosomal protein L9e [Cicindela litorea] | | Seq No.304 | ta02181.002_diavv | 789 |
| idv1c.pk057.e11.f | eukaryotic translation initiation factor 2 gamma subunit | | Seq No.308 | ta02330.001_diavv | 1691 |
| idv1c.pk057.h7.f | heat shock protein 70 | | Seq No.312 | ta00491.010_diavv | 2609 |
| idv1c.pk057.n10.f | V-type proton ATPase subunit B | | Seq No.316 | ta00620.001_diavv | 2583 |
| idv1c.pk058.b17.f | Calmodulin 1 (phosphorylase kinase, delta) | | Seq No.320 | ta02046.005_diavv | 713 |
| idv1c.pk058.i15.f | coatomer subunit beta [Tribolium castaneum] | | Seq No.324 | ta00934.001_diavv | 3271 |
| idv1c.pk058.p1.f | heat shock cognate 70 | | Seq No.328 | 454run12_isotig00560 | 2209 |
| idv1c.pk055.m8.f | Small GTPase superfamily, Ras type protein | | Seq No.332 | ta00232.001_diavv | 4464 |
| idv1c.pk060.g1.f | Homo sapiens PAC clone RP5-1007H16 from 7 | | Seq No.336 | ta41917.001_diavv | 737 |
| idv1c.pk060.g5.f | RNA-dependent DNA polymerase | | Seq No.340 | ta03247.005_diavv | 3813 |
| idv1c.pk062.o19 | proteasome subunit alpha type 2 | | Seq No.344 | ta03948.001_diavv | 857 |
| idv3c.pk001.a13.f | acidic p0 ribosomal protein | | Seq No.348 | ta20424.001_diavv | 1042 |
| idv1c.pk062.d24.f | similar to serine palmitoyltransferase | | Seq No.352 | ta00669.001_diavv | 2113 |
| idv3c.pk007.i8.f | Cytoplasmic actin | | Seq No.356 | ta15851.001_diavv | 1465 |
| idv3c.pk008.h22.f | H+ATPase V-type subunit | | Seq No.360 | ta15854.001_diavv | 2938 |
| idv3c.pk011.g2.f | similar to ribosomal protein L14 | | Seq No.364 | ta01695.001_diavv | 689 |
| idv3c.pk012.e23.f | similar to CG32019-PA [Tribolium castaneum] | | Seq No.368 | ta35139.001_diavv | 6974 |
| idv3c.pk013.g12.f | ubiquitin/ribosomal protein S27Ae fusion protein | | Seq No.372 | ta06472.004_diavv | 683 |
| idv3c.pk016.a10.f | actin-depolymerizing factor 1 [Bombyx mori] | | Seq No.376 | ta00957.001_diavv | 1099 |
| idv3c.pk016.g12.f | putative ribosomal protein L17/23 [Diaphorina citri] | | Seq No.380 | ta01259.001_diavv | 667 |
| idv3c.pk016.l10.f | Polyadenylate-binding protein | | Seq No.384 | ta16449.001_diavv | 2656 |

FIG. 1N

| cDNA ID | GENE ID | Target Name | Seq No. (WCRW transcript sequences) | Transcript ID | Length |
|---|---|---|---|---|---|
| idv3c.pk026.f22.f | MLE protein [Bombyx mori] | | Seq No.388 | ta01430.001_diavv | 4007 |
| iwmhipc.pk001.d23.f | actin | | Seq No.392 | ta02481.002_diavv | 1534 |
| iwmhipc.pk001.d24.f | unknown | | Seq No.396 | ta08003.008_diavv | 1208 |
| iwmhipc.pk003.i17.f | transport protein Sec61 subunit alpha 2 | | Seq No.400 | ta03313.003_diavv | 2110 |
| iwmhipc.pk006.g5.f | ribosomal protein L6 | | Seq No.404 | ta17558.001_diavv | 1036 |
| iwmhipc.pk005.l16.f | ribosomal protein S6 kinase beta-1-like isoform 1 | | Seq No.408 | ta00443.001_diavv | 2032 |
| iwmhipc.pk003.o14.f | S5e ribosomal protein | | Seq No.412 | 454run3_isotig03469 | 780 |
| iwmhipc.pk004.b8.f | ribosomal protein L15e | | Seq No.416 | ta18374.001_diavv | 1374 |
| iwmhipc.pk004.d7.f | ribosomal protein L10e | | Seq No.420 | ta04337.003_diavv | 726 |
| iwmhipc.pk006.o23.f | ribosomal protein L10Ae | | Seq No.424 | ta02345.005_diavv | 1055 |
| iwmhipc.pk011.g12.f | UPF0464 protein C15orf44 homolog [Nasonia vitripennis] | | Seq No.428 | ta10911.001_diavv | 1551 |
| iwmhipc.pk011.i2.f | Heat shock protein DnaJ | | Seq No.432 | ta05539.003_diavv | 1310 |
| iwmhipc.pk011.j6.f | nubbin [Tribolium castaneum] | | Seq No.436 | ta21806.001_diavv | 698 |
| iwmhipc.pk011.j4.f | Conserved oligomeric Golgi complex, subunit 6 | | Seq No.440 | ta21805.001_diavv | 727 |
| iwmhipc.pk011.l17.f | Peptidase C2, calpain, large subunit | | Seq No.444 | ta05594.001_diavv | 2478 |
| iwmhipc.pk023.f4.f | cadherin-like gene | | Seq No.448 | ta21896.001_diavv | 628 |
| iwmhipc.pk023.k22.f | Acetyl-coa acetyltransferase | | Seq No.452 | ta05758.001_diavv | 1541 |
| iwmhipc.pk023.l2.f | Cordon-bleu protein-like 1 | | Seq No.456 | ta14242.001_diavv | 736 |
| iwmhipc.pk023.j22.f | Prohibitin protein | | Seq No.460 | ta06694.001_diavv | 1170 |
| iwmhipc.pk026.a10.f | Multisynthetase complex, auxiliary protein | | Seq No.464 | ta07588.001_diavv | 1170 |
| iwmhipc.pk026.m2.f | KN motif and ankyrin repeat domain-containing protein 1-like protein | | Seq No.468 | ta01520.001_diavv | 3569 |
| iwmhipc.pk030.p16 | ubiquitin B | | Seq No.472 | ta21603.001_diavv | 703 |
| iwmhipc.pk030.l7.f | eukaryotic release factor 1 CG5605-PA | | Seq No.476 | ta00933.001_diavv | 2829 |
| iwmhipc.pk028.c16.f | vacuolar ATPase subunit C | | Seq No.480 | ta01215.004_diavv | 2409 |
| iwmhipc.pk031.d11.f | ribosomal protein L7 | | Seq No.484 | ta05864.001_diavv | 855 |
| iwmhipc.pk031.j10.f | V-type proton ATPase subunit e-like protein | | Seq No.488 | ta06727.001_diavv | 656 |

FIG. 10

| cDNA ID | GENE ID | Target Name | Seq No. (WCRW transcript sequences) | Transcript ID | Length |
|---|---|---|---|---|---|
| iwmhipc.pk032.j18.f | skd/vacuolar sorting | | Seq No.492 | ta02217.001_diavv | 2068 |
| iwmhipc.pk034.h8.f | Vacuolar proton pump subunit H | | Seq No.496 | ta02168.002_diavv | 1830 |
| iwmhipc.pk034.i20.f | Eukaryotic translation initiation factor 3 subunit G-like protein | | Seq No.500 | ta06291.001_diavv | 1014 |
| iwmhipc.pk036.f24.f | Coatomer protein complex subunit delta | | Seq No.504 | ta03896.001_diavv | 1812 |
| iwmhipc.pk039.j12.f | eukaryotic translation initiation factor 3 subunit C-like | | Seq No.508 | ta05048.001_diavv | 2785 |
| iwmhipc.pk039.k19.f | Cytochrome P450 CYP9Z1 (Cyp9z1) | | Seq No.512 | ta01391.001_diavv | 2131 |
| iwmhipc.pk040.n14.f | ribosomal protein S23-like protein | | Seq No.516 | ta00545.001_diavv | 616 |
| iwmhipc.pk041.n17.f | Eukaryotic translation initiation factor 3 subunit 9 | | Seq No.520 | ta01172.001_diavv | 2397 |
| iwmhipc.pk052.j3.f | ATP synthase alpha subunit vacuolar | | Seq No.524 | ta01291.009_diavv | 2533 |
| iwmlopc.pk002.f13.f | ribosomal protein L21 | | Seq No.528 | ta01222.003_diavv | 696 |
| iwmlopc.pk031.c23.f | ribosomal protein | | Seq No.532 | ta05572.002_diavv | 596 |
| iwmlopc.pk038.m15.f | ATP synthase, H+ transporting, mitochondrial F1 complex, delta subunit | | Seq No.536 | ta03508.001_diavv | 797 |
| iwmlopc.pk042.g3.f | unknown | | Seq No.540 | ta03675.001_diavv | 893 |
| iwmlopc.pk006.g13.f | 60S ribosomal protein L23a-like | | Seq No.544 | ta00525.004_diavv | 1017 |
| iwmlopc.pk006.g16.f | ribosomal protein L18e | | Seq No.548 | ta05162.001_diavv | 793 |
| iwmlopc.pk007.g1.f | ribosomal protein L35A | | Seq No.552 | ta00344.005_diavv | 1008 |
| iwmlopc.pk015.h20.f | ribosomal protein L12e | | Seq No.556 | ta01789.001_diavv | 768 |
| iwmlopc.pk022.p14.f | ribosomal protein S11 | | Seq No.560 | ta02086.002_diavv | 615 |

FIG. 2A

Table 2

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-HP2-FIS | idv1c.pk037.j20.f | hypothetical protein | 3 | 0.560 | 1.738 | 0.366 | Seq No.001 | 593 |
| DV-HP2-FRAG1 | idv1c.pk037.j20.f | hypothetical protein | 2.625 | 0.450 | 0.447 | 0.149 | Seq No.561 | 225 |
| DV-HP2-FRAG2 | idv1c.pk037.j20.f | hypothetical protein | 2.625 | 0.350 | 1.947 | 0.331 | Seq No.562 | 212 |
| DV-HP2-FRAG3 | idv1c.pk037.j20.f | hypothetical protein | 2.625 | 0.516 | 1.321 | 0.158 | Seq No.563 | 210 |
| DV-HP2-FRAG4 | idv1c.pk037.j20.f | hypothetical protein | 3 | 4.688 | | | Seq No.564 | 229 |
| DV-HP2-FRAG5 | idv1c.pk037.j20.f | hypothetical protein | 2.625 | 0.356 | 0.752 | 0.255 | Seq No.565 | 170 |
| DV-HP2-FRAG6 | idv1c.pk037.j20.f | hypothetical protein | 2.375 | | | | Seq No.566 | 233 |
| DV-HP2-FRAG7 | idv1c.pk037.j20.f | hypothetical protein | 2.375 | 0.056 | 0.121 | 0.054 | Seq No.567 | 162 |
| DV-HP2-FRAG8 | idv1c.pk037.j20.f | hypothetical protein | 2.286 | 0.087 | 0.112 | 0.053 | Seq No.568 | 473 |
| DV-HP2-FRAG9 | idv1c.pk037.j20.f | hypothetical protein | 2.143 | 0.097 | 0.221 | 0.087 | Seq No.569 | 430 |
| DV-HP2-FRAG10 | idv1c.pk037.j20.f | hypothetical protein | 2 | 0.236 | 0.675 | 0.138 | Seq No.570 | 486 |
| DV-HP2-FRAG11 | idv1c.pk037.j20.f | hypothetical protein | 2.125 | 0.344 | 0.341 | 0.046 | Seq No.571 | 500 |
| DV-HP2-FRAG12 | idv1c.pk037.j20.f | hypothetical protein | 2.125 | 0.346 | 0.429 | 0.074 | Seq No.572 | 310 |
| DV-RYANR-FIS | idv1c.pk035.i17.f:fis | ryanodine receptor-like protein | 2.75 | 0.480 | | | Seq No.573 | 1327 |
| DV-RYANR-FRAG1 | idv1c.pk035.i17.f:fis | ryanodine receptor-like protein | 2.875 | 0.277 | 0.045 | 0.014 | Seq No.574 | 194 |
| DV-RYANR-FRAG2 | idv1c.pk035.i17.f:fis | ryanodine receptor-like protein | 3 | 0.006 | 0.098 | 0.014 | Seq No.575 | 145 |

FIG. 2B

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-RYANR-FRAG3 | idv1c.pk035.i17.f:fis | ryanodine receptor-like protein | 2.875 | 0.004 | 0.036 | 0.011 | Seq No.576 | 83 |
| DV-RYANR-FRAG4 | idv1c.pk035.i17.f:fis | ryanodine receptor-like protein | 2.375 | 0.062 | 0.044 | 0.015 | Seq No.577 | 292 |
| DV-RYANR-FRAG5 | idv1c.pk035.i17.f:fis | ryanodine receptor-like protein | 2 | 0.013 | 0.163 | 0.300 | Seq No.578 | 502 |
| DV-RYANR-FRAG6 | idv1c.pk035.i17.f:fis | ryanodine receptor-like protein | 1.1429 | | | | Seq No.579 | 199 |
| DV-RYANR-FRAG7 | idv1c.pk035.i17.f:fis | ryanodine receptor-like protein | 0.5 | | | | Seq No.580 | 197 |
| DV-RYANR-FRAG8 | idv1c.pk035.i17.f:fis | ryanodine receptor-like protein | 2.25 | 0.123 | | | Seq No.581 | 142 |
| DV-RYANR-FRAG9 | idv1c.pk035.i17.f:fis | ryanodine receptor-like protein | 2.625 | 0.145 | 0.411 | 0.090 | Seq No.582 | 129 |
| DV-RYANR-FRAG10 | idv1c.pk035.i17.f:fis | ryanodine receptor-like protein | 2.375 | 0.336 | 0.492 | 0.126 | Seq No.583 | 152 |
| DV-RASRHO-FIS | idv1c.pk037.j14.f | Ras-like GTP-binding protein Rho1 | 2.625 | | | | Seq No.584 | 587 |
| DV-RASRHO-FRAG1 | idv1c.pk037.j14.f | Ras-like GTP-binding protein Rho2 | 2.3 | 3.860 | | | Seq No.585 | 163 |
| DV-DEAD-FIS | idv1c.pk038.d14.f | DEAD box ATP-dependent RNA helicase | 2.625 | no | | | Seq No.101 | 614 |
| DV-DEAD-FRAG1 | idv1c.pk038.d14.f | DEAD box ATP-dependent RNA helicase | 2.25 | 51.509 | | | Seq No.586 | 178 |
| DV-HPP15-FIS | idv1c.pk040.c10.f | hypothetical protein-similar to p15-2a protein | 2.6 | 31.170 | | | Seq No.113 | 368 |
| DV-HPP15-FRAG1 | idv1c.pk040.c10.f | hypothetical protein-similar to p15-2a protein | 1.4 | | | | Seq No.587 | 152 |
| DV-BPSAR2-FIS | idv1c.pk015.b8.f:fis | GTP-binding protein SAR2 | 3 | 0.018 | 1.471 | 0.103 | Seq No.065 | 716 |
| DV-BPSAR2-FRAG1 | idv1c.pk015.b8.f:fis | GTP-binding protein SAR2 | 2.75 | 0.532 | 1.306 | 0.154 | Seq No.588 | 402 |
| DV-BPSAR2-FRAG2 | idv1c.pk015.b8.f:fis | GTP-binding protein SAR3 | 2.375 | 0.197 | 29.630 | 0.317 | Seq No.589 | 171 |
| DV-BPSAR2-FRAG3 | idv1c.pk015.b8.f:fis | GTP-binding protein SAR4 | 2.125 | 6.481 | 1.907 | 0.230 | Seq No.590 | 137 |

FIG. 2C

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-BPSAR2-FRAG3 | idv1c.pk015.b8.f:fis | GTP-binding protein SAR4 | 2.125 | 6.481 | 1.907 | 0.230 | Seq No.590 | 137 |
| DV-BPSAR2-FRAG4 | idv1c.pk015.b8.f:fis | GTP-binding protein SAR5 | 2.375 | | | | Seq No.591 | 135 |
| DV-BPSAR2-FRAG5 | idv1c.pk015.b8.f:fis | GTP-binding protein SAR2 | 0.75 | | | | Seq No.592 | 294 |
| DV-BPSAR2-FRAG6 | idv1c.pk015.b8.f:fis | GTP-binding protein SAR2 | 0.625 | | | | Seq No.593 | 407 |
| DV-HP1-FIS | idv1c.pk026.d10.f | Nucleosome Core, Chain C | 2.625 | 5.470 | | | Seq No.077 | 319 |
| DV-HP1-FRAG1 | idv1c.pk026.d10.f | hypothetical protein | 2.5 | 0.911 | 6.501 | 0.797 | Seq No.594 | 168 |
| DV-HP1-FRAG2 | idv1c.pk026.d10.f | hypothetical protein | 2.375 | | | | Seq No.595 | 190 |
| DV-HP1-FRAG3 | idv1c.pk026.d10.f | hypothetical protein | 2.75 | 4.217 | | | Seq No.596 | 159 |
| DV-RNAPOL-FIS | idv1c.pk034.k22.f:fis | DNA directed RNA polymerase I | 2.6 | 3.068 | | | Seq No.009 | 445 |
| DV-RNAPOL-FRAG1 | idv1c.pk034.k22.f:fis | DNA directed RNA polymerase I | 1.8 | | | | Seq No.597 | 196 |
| DV-CPNN-FIS | iwc1c.pk026.h16 | chaperonin | 1.8 | 12.600 | | | Seq No.037 | 635 |
| DV-CPNN-FRAG1 | iwc1c.pk026.h16 | chaperonin | 0.5 | | | | Seq No.598 | 163 |
| DV-CPNN-FRAG2 | iwc1c.pk026.h16 | chaperonin | 1.3 | | | | Seq No.599 | 236 |
| DV-CPNN-FRAG3 | iwc1c.pk026.h16 | chaperonin | 1.1 | | | | Seq No.600 | 149 |
| DV-CPNN-FRAG4 | iwc1c.pk026.h16 | chaperonin | 2.1 | | | | Seq No.601 | 194 |
| DV-TEF2-FIS | iwc1c.pk029.h21 | translation elongation factor 2 | 2.4 | | | | Seq No.045 | 670 |
| DV-TEF2-FRAG1 | iwc1c.pk029.h21 | translation elongation factor 2 | 2.1 | 2.880 | 0.832 | 0.064 | Seq No.602 | 785 |
| DV-SRP54-FIS | iwm2c.pk004.m2 | signal recognition particle 54 kda protein | 2.6 | | | | Seq No.049 | 528 |

FIG. 2D

| Target Name | Initial SEQ ID | Frag GENE ID | primary assay | Informal iC50 | Formal LC50 | Formal IC50 | Seq No. | Length (bp) |
|---|---|---|---|---|---|---|---|---|
| DV-SRP54-FRAG1 | iwm2c.pk004.m2 | signal recognition particle 54 kda protein | 2.125 | | | | Seq No.603 | 144 |
| DV-SRP54-FRAG2 | iwm2c.pk004.m2 | signal recognition particle 54 kda protein | 1.75 | | | | Seq No.604 | 364 |
| DV-SRP54-FRAG3 | iwm2c.pk004.m2 | signal recognition particle 54 kda protein | 1.75 | 8.900 | 100.000 | 8.235 | Seq No.605 | 226 |
| DV-SRP54-FRAG4 | iwm2c.pk004.m2 | signal recognition particle 54 kda protein | 2.125 | | | | Seq No.606 | 163 |
| DV-TIF3-FIS | iwm2c.pk008.e24 | translation initiation factor 3 | 2.5 | | | | Seq No.061 | 588 |
| DV-TIF3-FRAG1 | iwm2c.pk008.e24 | translation initiation factor 3 | 1.3 | 174.500 | | | Seq No.607 | 171 |
| DV-TIF3-FRAG2 | iwm2c.pk008.e24 | translation initiation factor 3 | 1.625 | | | | Seq No.608 | 232 |
| DV-TIF3-FRAG3 | iwm2c.pk008.e24 | translation initiation factor 3 | 1.3 | | | | Seq No.609 | 166 |
| DV-TIF3-FRAG4 | iwm2c.pk008.e24 | translation initiation factor 3 | 0.9 | | | | Seq No.610 | 239 |
| DV-TIF3-FRAG5 | iwm2c.pk008.e24 | translation initiation factor 3 | 1.4 | | | | Seq No.611 | 227 |
| DV-TIF3-FRAG6 | iwm2c.pk008.e24 | translation initiation factor 3 | 0.9 | | | | Seq No.612 | 224 |
| DV-TIF3-FRAG7 | iwm2c.pk008.e24 | translation initiation factor 3 | 1.1 | | | | Seq No.613 | 154 |
| DV-TIF3-FRAG8 | iwm2c.pk008.e24 | translation initiation factor 3 | 2.3 | 15.700 | | | Seq No.614 | 742 |
| DV-TIF3-FRAG9 | iwm2c.pk008.e24 | translation initiation factor 3 | 2.0 | 104.140 | | | Seq No.615 | 619 |
| DV-EIF-4A-FIS | idv1c.pk044.p3.f | Eukaryotic initiation factor 4A-like | 1.5 | | | | Seq No.233 | 669 |
| DV-EIF-4A-Frag 2 | idv1c.pk044.p3.f | Eukaryotic initiation factor 4A-like | 2.25 | 0.046 | 0.325 | 0.088 | Seq No.616 | 713 |
| DV-EIF-4A-FRAG3 | idv1c.pk044.p3.f | Eukaryotic initiation factor 4A-like | 2 | 0.579 | | | Seq No.617 | 200 |

FIG. 2E

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-PAT3-FIS | idv1c.pk002.j17.f:fis | proteosome subunit alpha type 3 | 2.43 | | | | Seq No.137 | 589 |
| DV-PAT3-SS1 | idv1c.pk002.j17.f:fis | proteosome subunit alpha type 3 | 1.5 | 7.089 | 0.664 | 0.091 | Seq No.618 | 270 |
| DV-PAT3-FRAG5 | idv1c.pk002.j17.f:fis | proteosome subunit alpha type 3 | 2.5 | 2.000 | 27.980 | 0.992 | Seq No.619 | 322 |
| DV-PAT3-FRAG6 | idv1c.pk002.j17.f:fis | proteosome subunit alpha type 3 | 2.5 | 3.000 | | | Seq No.620 | 322 |
| DV-PAT3-FRAG7 | idv1c.pk002.j17.f:fis | proteosome subunit alpha type 3 | 2.5 | 2.000 | 90.480 | 3.526 | Seq No.621 | 161 |
| DV-PAT3-FRAG8 | idv1c.pk002.j17.f:fis | proteosome subunit alpha type 3 | 2.5 | 18.500 | 1.995 | 0.223 | Seq No.622 | 161 |
| DV-PAT3-FRAG9 | idv1c.pk002.j17.f:fis | proteosome subunit alpha type 3 | 2.5 | 8.300 | 11.430 | 0.269 | Seq No.623 | 161 |
| DV-PAT3-FRAG10 | idv1c.pk002.j17.f:fis | proteosome subunit alpha type 3 | 2.5 | 8.200 | 88.860 | 0.380 | Seq No.624 | 161 |
| DV-PAT3-FRAG11 | idv1c.pk002.j17.f:fis | proteosome subunit alpha type 3 | 2 | 5.930 | | | Seq No.625 | 162 |
| DV-PAT3-FRAG12 | idv1c.pk002.j17.f:fis | proteosome subunit alpha type 3 | 2 | 5.700 | 0.200 | | Seq No.626 | 160 |
| DV-PAT3-FRAG13 | idv1c.pk002.j17.f:fis | proteosome subunit alpha type 3 | 2 | 0.010 | 0.541 | 0.023 | Seq No.627 | 161 |
| DV-PAT3-FRAG14 | idv1c.pk002.j17.f:fis | proteosome subunit alpha type 3 | 1 | | | | Seq No.628 | 80 |
| DV-PAT3-FRAG15 | idv1c.pk002.j17.f:fis | proteosome subunit alpha type 3 | 1.25 | | | | Seq No.629 | 81 |
| DV-PAT3-FRAG16 | idv1c.pk002.j17.f:fis | proteosome subunit alpha type 3 | 2.25 | 2.820 | | | Seq No.630 | 80 |
| DV-PAT3-FRAG17 | idv1c.pk002.j17.f:fis | proteosome subunit alpha type 3 | 1 | | | | Seq No.631 | 81 |
| DV-PAT3-FRAG18 | idv1c.pk002.j17.f:fis | proteosome subunit alpha type 3 | 2 | 8.317 | 56.730 | 8.084 | Seq No.632 | 80 |
| DV-PAT3-FRAG19 | idv1c.pk002.j17.f:fis | proteosome subunit alpha type 3 | 2 | 4.714 | 40.030 | 3.628 | Seq No.633 | 81 |

FIG. 2F

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-PAT3-FRAG20 | idv1c.pk002.j17.f.fis | proteosome subunit alpha type 3 | 1 | 6.220 | 0.522 | 0.074 | Seq No.634 | 80 |
| DV-PAT3-FRAG21 | idv1c.pk002.j17.f.fis | proteosome subunit alpha type 3 | 1 | 45.000 | 83.610 | 0.502 | Seq No.635 | 81 |
| DV-PAT3-FIS (TR) | idv1c.pk002.j17.f.fis | proteosome subunit alpha type 3 | 2.5 | 2.000 | 25.800 | 0.333 | Seq No.636 | 644 |
| DV-PAT3-FRAG22 | idv1c.pk002.j17.f.fis | proteosome subunit alpha type 3 | 2.5 | 23.200 | | | Seq No.637 | 367 |
| DV-PAT3-FRAG23 | idv1c.pk002.j17.f.fis | proteosome subunit alpha type 3 | 2.5 | 11.400 | | | Seq No.638 | 182 |
| DV-PAT3-FRAG24 | idv1c.pk002.j17.f.fis | proteosome subunit alpha type 3 | 0 | | | | Seq No.639 | 185 |
| DV-PAT5-FIS | iwc1s.pk003.m17 | proteosome subunit alpha type, 5 | 2.38 | | | | Seq No.217 | 469 |
| DV-PAT5-Frag1 | iwc1s.pk003.m17 | proteosome subunit alpha type, 5 | 1.43 | | | | Seq No.640 | 256 |
| DV-PAT6-FIS | idv1c.pk033.j21.f.fis | proteasome subunit alpha type 6 | 2.625 | | | | Seq No.153 | 473 |
| DV-PAT6-FRAG1 | idv1c.pk033.j21.f.fis | proteasome subunit alpha type 6 | 2.125 | | | | Seq No.641 | 200 |
| DV-PAT6-FRAG2 | idv1c.pk033.j21.f.fis | proteasome subunit alpha type 6 | 1.875 | | | | Seq No.642 | 216 |
| DV-PAT6-FRAG3 | idv1c.pk033.j21.f.fis | proteasome subunit alpha type 6 | 1.875 | | | | Seq No.643 | 200 |
| DV-PAT6-FRAG4 | idv1c.pk033.j21.f.fis | proteasome subunit alpha type 6 | 2 | 0.722 | 200.000 | 200.000 | Seq No.644 | 195 |
| DV-PAT6-FRAG5 | idv1c.pk033.j21.f.fis | proteasome subunit alpha type 6 | 1.625 | 2.265 | 2.105 | 0.266 | Seq No.645 | 199 |
| DV-PAT6-FRAG6 | idv1c.pk033.j21.f.fis | proteasome subunit alpha type 6 | 2.25 | 2.405 | 29.790 | 1.865 | Seq No.646 | 165 |
| DV-PAT6-FRAG7 | idv1c.pk033.j21.f.fis | proteasome subunit alpha type 6 | 1.67 | 1.784 | 0.853 | 0.089 | Seq No.647 | 157 |
| DV-BETA2-FIS | irw1c.pk011.c3.f | proteasome subunit beta type, 2 | 2.38 | 0.346 | 3.826 | 0.089 | Seq No.185 | 716 |

FIG. 2G

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-BETA2-FRAG1 | irw1c.pk011.c3.f | proteasome subunit beta type, 2 | 2.00 | 5.750 | | | Seq No.648 | 196 |
| DV-BETA2-FRAG2 | irw1c.pk011.c3.f | proteasome subunit beta type, 2 | 1.13 | | | | Seq No.649 | 187 |
| DV-BETA2-FRAG3 | irw1c.pk011.c3.f | proteasome subunit beta type, 2 | 2 | 0.492 | | | Seq No.650 | 155 |
| DV-BETA3-FIS | idv1c.pk040.m14.f | proteasome subunit beta type, 3 | 2.8 | | | | Seq No.157 | 451 |
| DV-BETA3-FRAG1 | idv1c.pk040.m14.f | proteasome subunit beta type, 3 | 2.125 | 2.270 | 4.533 | 0.468 | Seq No.651 | 174 |
| DV-PROTB-FIS | idv1c.pk003.d6.f:fis | Proteosome subunit beta type 1 | 2.25 | 0.010 | 4.105 | 0.186 | Seq No.141 | 577 |
| DV-PROTB-FRAG1 | idv1c.pk003.d6.f:fis | Proteosome subunit beta type 1 | 2.125 | 0.198 | 4.558 | 0.047 | Seq No.652 | 203 |
| DV-PBT6.2-FIS | idv1c.pk016.h19.f:fis | Proteosome subunit beta type 6 | 2.63 | | | | Seq No.145 | 542 |
| DV-PBT6.2-FRAG1 | idv1c.pk016.h19.f:fis | Proteosome subunit beta type 6 | 2 | 0.108 | | | Seq No.653 | 291 |
| DV-PBT6.2-FRAG2 | idv1c.pk016.h19.f:fis | Proteosome subunit beta type 6 | 2.6 | 0.071 | | | Seq No.654 | 277 |
| DV-PBT6.2-FRAG3 | idv1c.pk016.h19.f:fis | Proteosome subunit beta type 6 | 2.6 | | | | Seq No.655 | 257 |
| DV-PBT6.2-FRAG4 | idv1c.pk016.h19.f:fis | Proteosome subunit beta type 6 | 2 | | | | Seq No.656 | 273 |
| DV-PBT6.2-FRAG5 | idv1c.pk016.h19.f:fis | Proteosome subunit beta type 6 | 2.125 | 0.479 | | | Seq No.657 | 219 |
| DV-PBT6.2-FRAG6 | idv1c.pk016.h19.f:fis | Proteosome subunit beta type 6 | 2.75 | 0.068 | 11.940 | 0.047 | Seq No.658 | 151 |
| DV-BETA7-FIS | idv1c.pk047.i11.f | Proteosome subunit beta type 7 | 2.00 | | | | Seq No.169 | 558 |
| DV-BETA7-FRAG1 | idv1c.pk047.i11.f | Proteosome subunit beta type 7 | 1.63 | | | | Seq No.659 | 229 |
| DV-BETA7-FRAG2 | idv1c.pk047.i11.f | Proteosome subunit beta type 7 | 2 | 14.040 | | | Seq No.660 | 285 |

FIG. 2H

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-BETA7-FRAG3 | idv1c.pk047.i11.f | Proteosome subunit beta type 7 | 2.00 | | | | Seq No.661 | 188 |
| DV-BETA7-FRAG4 | idv1c.pk047.i11.f | Proteosome subunit beta type 7 | 2.00 | 26.580 | | | Seq No.662 | 150 |
| DV-BETA7-FRAG5 | idv1c.pk047.i11.f | Proteosome subunit beta type 7 | 2.25 | 38.900 | | | Seq No.663 | 168 |
| DV-BETA7-FRAG6 | idv1c.pk047.i11.f | Proteosome subunit beta type 7 | 2.13 | 24.990 | | | Seq No.664 | 156 |
| DV-NATP1-FIS | iwm2s.pk015.k15 | Proteosome 26S subunit, non-ATPase, 1 | 2.25 | | | | Seq No.225 | 455 |
| DV-NATP1-FRAG1 | iwm2s.pk015.k15 | Proteosome 26S subunit, non-ATPase, 1 | 2.25 | 0.435 | 3.806 | 0.192 | Seq No.665 | 220 |
| DV-NATP1-FRAG2 | iwm2s.pk015.k15 | Proteosome 26S subunit, non-ATPase, 1 | 2.00 | | | | Seq No.666 | 222 |
| DV-NATP1-FRAG3 | iwm2s.pk015.k15 | Proteosome 26S subunit, non-ATPase, 1 | 2.00 | | | | Seq No.667 | 204 |
| DV-NATP1-FRAG4 | iwm2s.pk015.k15 | Proteosome 26S subunit, non-ATPase, 1 | 2.13 | | | | Seq No.668 | 155 |
| DV-NATP1-FRAG5 | iwm2s.pk015.k15 | Proteosome 26S subunit, non-ATPase, 1 | 2.00 | | | | Seq No.669 | 226 |
| DV-NATP1-FRAG6 | iwm2s.pk015.k15 | Proteosome 26S subunit, non-ATPase, 1 | 2.28 | | | | Seq No.670 | 205 |
| DV-NATP1-FRAG7 | iwm2s.pk015.k15 | Proteosome 26S subunit, non-ATPase, 1 | 2.25 | | | | Seq No.671 | 236 |
| DV-NATP1-FRAG8 | iwm2s.pk015.k15 | Proteosome 26S subunit, non-ATPase, 1 | 2.00 | 0.142 | 4.590 | 0.120 | Seq No.672 | 200 |
| DV-NATP2-FIS | iwc1c.pk003.n19 | Proteosome 26S subunit, non-ATPase, 2 | 2.25 | | | | Seq No.189 | 364 |
| DV-NATP2-FRAG1 | iwc1c.pk003.n19 | Proteosome 26S subunit, non-ATPase, 2 | 0.25 | | | | Seq No.673 | 199 |
| DV-NATP2-FRAG2 | iwc1c.pk003.n19 | Proteosome 26S subunit, non-ATPase, 2 | 0.375 | | | | Seq No.674 | 198 |
| DV-NATP2-FRAG3 | iwc1c.pk003.n19 | Proteosome 26S subunit, non-ATPase, 2 | 0 | | | | Seq No.675 | 190 |

FIG. 2I

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-NATP2-FRAG4 | iwc1c.pk003.n19 | Proteosome 26S subunit, non-ATPase, 2 | 0 | | | | Seq No.676 | 223 |
| DV-NATP2-FRAG5 | iwc1c.pk003.n19 | Proteosome 26S subunit, non-ATPase, 2 | 2.125 | | | | Seq No.677 | 165 |
| DV-NATP2-FRAG6 | iwc1c.pk003.n19 | Proteosome 26S subunit, non-ATPase, 2 | 1.625 | | | | Seq No.678 | 156 |
| DV-NATP3-FIS | idv1c.pk025.a4.f:fis | Proteosome 26S subunit, non-ATPase, 3 | 2.63 | 0.209 | 2.715 | 0.236 | Seq No.149 | 559 |
| DV-NATP3-FRAG1 | idv1c.pk025.a4.f:fis | Proteosome 26S subunit, non-ATPase, 3 | 2.4 | 21.470 | | | Seq No.679 | 222 |
| DV-NATP3-FRAG2 | idv1c.pk025.a4.f:fis | Proteosome 26S subunit, non-ATPase, 3 | 2.13 | 38.736 | | | Seq No.680 | 222 |
| DV-NATP3-FRAG3 | idv1c.pk025.a4.f:fis | Proteosome 26S subunit, non-ATPase, 3 | 2.00 | 0.515.3 | 33.680 | 0.889 | Seq No.681 | 159 |
| DV-NATP7-FIS | idv1c.pk053.i16.f | Proteosome 26S subunit, non-ATPase, 7 | 2.25 | 0.280 | 2.105 | 0.735 | Seq No.173 | 473 |
| DV-NATP7-FRAG1 | idv1c.pk053.i16.f | Proteosome 26S subunit, non-ATPase, 7 | 1.8 | | | | Seq No.682 | 161 |
| DV-NATP8-FIS | irw1c.pk010.o11.f | Proteosome 26S subunit, non-ATPase, 8 | 2.50 | | | | Seq No.181 | 420 |
| DV-NATP8-FRAG1 | irw1c.pk010.o11.f | Proteosome 26S subunit, non-ATPase, 8 | 2.00 | | | | Seq No.683 | 151 |
| DV-NATP8-FRAG2 | irw1c.pk010.o11.f | Proteosome 26S subunit, non-ATPase, 8 | 2.00 | | | | Seq No.684 | 163 |
| DV-NATP8-FRAG3 | irw1c.pk010.o11.f | Proteosome 26S subunit, non-ATPase, 8 | 2.13 | 0.390 | 11.607 | 0.193 | Seq No.685 | 172 |
| DV-NATP14-FIS | idv1c.pk046.m13.f | Proteosome 26S subunit, non-ATPase, 14 | 2.13 | 0.443 | 0.623 | 0.167 | Seq No.686 | 673 |
| DV-NATP14-FRAG1 | idv1c.pk046.m13.f | Proteosome 26S subunit, non-ATPase, 14 | 0.00 | | | | Seq No.687 | 246 |
| DV-ATP5-FIS | iwc1c.pk022.i6 | Proteosome 26S subunit, ATPase, 5 | 2.00 | | | | Seq No.205 | 453 |
| DV-ATP5-FRAG1 | iwc1c.pk022.i6 | Proteosome 26S subunit, ATPase, 5 | 2 | 1.405 | 3.008 | 0.133 | Seq No.688 | 205 |

FIG. 2J

| Target Name | Initial SEQ ID | Frag GENE ID | primary assay | Informal IC50 | Formal LC50 | Formal IC50 | Seq No. | Length (bp) |
|---|---|---|---|---|---|---|---|---|
| DV-ATP5-FRAG2 | iwc1c.pk022.l6 | Proteasome 26S subunit, ATPase, 5 | 2 | 0.746 | 0.550 | 0.116 | Seq No.689 | 219 |
| DV-ATP5-FRAG3 | iwc1c.pk022.l6 | Proteasome 26S subunit, ATPase, 5 | 2 | 4.428 | | | Seq No.690 | 244 |
| DV-ATP5-FRAG4 | iwc1c.pk022.l6 | Proteasome 26S subunit, ATPase, 5 | 2.125 | 17.218 | | | Seq No.691 | 163 |
| DV-ATP5-FRAG5 | iwc1c.pk022.l6 | Proteasome 26S subunit, ATPase, 5 | 0.00 | | | | Seq No.692 | 176 |

FIG. 3A

Table 3

| Target | Insect sources | Target group | Transcript ID | Seq No. | length |
|---|---|---|---|---|---|
| Ryanr-Ssk | WCRW | target pest | ta00611.03_diavv | Seq No.693 | 1432 |
| Ryanr-Ssk | SCRW | target pest | ta01434.01_diaun | Seq No.694 | 730 |
| Ryanr-Ssk | NCRW | target pest | ta01092.02_diab | Seq No.695 | 1629 |
| Ryanr-Ssk | MBB | expanded pest | ta26722.002_epiva | Seq No.696 | 720 |
| Ryanr-Ssk | CPB | expanded pest | ta37400.0001_lepde | Seq No.697 | 1043 |
| Ryanr-Ssk | Orius | no target insect | ta01487.01_oriin | Seq No.698 | 648 |
| Ryanr-Ssk | CMAC | no target insect | ta21166.0001_vibdu | Seq No.699 | 820 |
| HP2-mesh | WCRW | target pest | ta01240.10_diavv | Seq No. 004 | 5689 |
| HP2-mesh | SCRW | target pest | ta00809.07_diaun | Seq No.700 | 5238 |
| HP2-mesh | NCRW | target pest | ta06241.06_diab | Seq No.701 | 4313 |
| HP2-mesh | MBB | expanded pest | ta29117.001_epiva | Seq No.702 | 1564 |
| HP2-mesh | CPB | expanded pest | ta36833.0009_lepde | Seq No.703 | 5020 |
| HP2-mesh | Orius | no target insect | ta02139.06_oriin | Seq No.704 | 3724 |
| HP2-mesh | CMAC | no target insect | ta22533.0010_vibdu | Seq No.705 | 3845 |

FIG. 3B

| Target | Insect sources | Target group | Transcript ID | Seq No. | length |
|---|---|---|---|---|---|
| PAT3 | WCRW | target pest | ta06609.01_diavv | Seq No. 140 | 956 |
| PAT3 | SCRW | target pest | ta01950.01_diaun | Seq No.706 | 982 |
| PAT3 | NCRW | target pest | ta01738.01_diab | Seq No.707 | 795 |
| PAT3 | MBB | expanded pest | ta26097.001_epiva | Seq No.708 | 993 |
| PAT3 | CPB | expanded pest | ta37784.0003_lepde | Seq No.709 | 936 |
| PAT3 | Orius | no target insect | ta09672.01_oriin | Seq No.710 | 927 |
| PAT3 | CMAC | no target insect | ta36121.0001_vibdu | Seq No.711 | 1115 |
| PROTB | WCRW | target pest | ta03835.01_diavv | Seq No.144 | 913 |
| PROTB | SCRW | target pest | ta07256.01_diaun | Seq No.712 | 853 |
| PROTB | NCRW | target pest | ta07284.01_diab | Seq No.713 | 856 |
| PROTB | MBB | expanded pest | ta27792.001_epiva | Seq No.714 | 796 |
| PROTB | CPB | expanded pest | ta37916.0001_lepde | Seq No.715 | 842 |
| PROTB | Orius | no target insect | ta09310.01_oriin | Seq No.716 | 755 |
| PROTB | CMAC | no target insect | ta23917.0001_vibdu | Seq No.717 | 813 |
| PBT6 | WCRW | target pest | ta02145.01_diavv | Seq No.148 | 850 |
| PBT6 | SCRW | target pest | ta08127.01_diaun | Seq No.718 | 785 |

FIG. 3C

| Target | Insect sources | Target group | Transcript ID | Seq No. | length |
|---|---|---|---|---|---|
| PBT6 | NCRW | target pest | ta05581.01_diab | Seq No.719 | 842 |
| PBT6 | MBB | expanded pest | ta23856.001_epiva | Seq No.720 | 935 |
| PBT6 | CPB | expanded pest | ta33564.0001_lepde | Seq No.721 | 1264 |
| PBT6 | Orius | no target insect | ta09100.01_oriin | Seq No.722 | 912 |
| PBT6 | CMAC | no target insect | ta16980.0001_vibdu | Seq No.723 | 686 |

FIG. 4

Amino acid sequence alignment of WCRW Ryanr and Drosophila Ssk

```
WCRW-Ryanr   (1) MTSIETVGTVKLLKLNLICLLYRTGYQGYFLGVCGTWNLNEEKNPDAEIVASGYFVGFMITFVS
fly-Ssk-PA   (1) MVSVETVGSFFKALKLNLVIFLYRWGDGGEFLGIGGTWNLNEEKSADAEIVASGVMKGFLYTGCH
                                                                              140
                  71

WCRW-Ryanr  (71) LSLCFASGDHKTFTDIMNIVGIFKWIAAGATALHYWLGIEYKTTIDSERQVGIAGAMCINGA
fly-Ssk-PA   (71) TIFFAIGTTKHKGELCDTMNIVGCIMWIAVGGVALHYWKGYMSDEGILYWNSERQVGIAMGSSLVEGA
                  141                163

WCRW-Ryanr (141) WILVDGVLSAIFILKKMQ---
fly-Ssk-PA  (141) FILLDTVLACIHYSKDTDYTQ-
```

COMPOSITIONS AND METHODS TO CONTROL INSECT PESTS

FIELD OF THE INVENTION

The present invention relates generally to methods of molecular biology and gene silencing to control pests.

REFERENCE TO A SEQUENCE LISTING SUBMITTED AS A TEXT FILE VIA EFS-WEB

The Sequence Listing submitted Jan. 9, 2014 as a text file named "36446_0007U2_12_17_13_Corrected_Sequence_Listing, " created on Dec. 17, 2013, and having a size of 691,142 bytes is hereby incorporated by reference pursuant to 37 C.F.R. §1.52(e)(5).

BACKGROUND OF THE INVENTION

Insect pests are a serious problem in agriculture. They destroy millions of acres of staple crops such as corn, soybeans, peas, and cotton. Yearly, these pests cause over $100 billion dollars in crop damage in the U.S. alone. In an ongoing seasonal battle, farmers must apply billions of gallons of synthetic pesticides to combat these pests. Other methods employed in the past delivered insecticidal activity by microorganisms or genes derived from microorganisms expressed in transgenic plants. For example, certain species of microorganisms of the genus *Bacillus* are known to possess pesticidal activity against a broad range of insect pests including *Lepidoptera, Diptera, Coleoptera, Hemiptera*, and others. In fact, microbial pesticides, particularly those obtained from *Bacillus* strains, have played an important role in agriculture as alternatives to chemical pest control. Agricultural scientists have developed crop plants with enhanced insect resistance by genetically engineering crop plants to produce insecticidal proteins from *Bacillus*. For example, corn and cotton plants genetically engineered to produce Cry toxins (see, e.g., Aronson (2002) *Cell Mol. Life. Sci.* 59(3):417-425; Schnepf et al. (1998) *Microbiol. Mol. Biol. Rev.* 62(3):775-806) are now widely used in American agriculture and have provided the farmer with an alternative to traditional insect-control methods. However, these Bt insecticidal proteins only protect plants from a relatively narrow range of pests. Moreover, these modes of insecticidal activity provided varying levels of specificity and, in some cases, caused significant environmental consequences. Thus, there is an immediate need for alternative methods to control pests.

BRIEF SUMMARY OF THE INVENTION

Methods and compositions are provided which employ a silencing element that, when ingested by a pest, such as Coleopteran plant pest including a *Diabrotica* plant pest, is capable of decreasing the expression of a target sequence in the pest. In specific embodiments, the decrease in expression of the target sequence controls the pest and thereby the methods and compositions are capable of limiting damage to a plant. The present invention provides various target polynucleotides as set forth in SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants or fragments thereof, or complements thereof, wherein a decrease in expression of one or more of the sequences in the target pest controls the pest (i.e., has insecticidal activity). Further provided are silencing elements, which when ingested by the pest, decrease the level of expression of one or more of the target polynucleotides. Plants, plant parts, plant cells, bacteria and other host cells comprising the silencing elements or an active variant or fragment thereof are also provided. Also provided are formulations of sprayable silencing agents for topical applications to pest insects or substrates where pest insects may be found.

In another embodiment, a method for controlling a pest, such as a Coleopteran plant pest or a *Diabrotica* plant pest, is provided. The method comprises feeding to a pest a composition comprising a silencing element, wherein the silencing element, when ingested by the pest, reduces the level of a target sequence in the pest and thereby controls the pest. Further provided are methods to protect a plant from a pest. Such methods comprise introducing into the plant or plant part a silencing element of the invention. When the plant expressing the silencing element is ingested by the pest, the level of the target sequence is decreased and the pest is controlled.

BRIEF DESCRIPTION OF THE DRAWINGS

FIGS. 1A-1O are tables, Tables 1A and 1B, which identifies RNAi active targets in diet assay using dsRNA produced by in vitro transcription (IVT).

FIGS. 2A-2J are a table, Table 2, which shows design and identification of RNAi active fragments.

FIGS. 3A-3C is a table, Table 3, which lists RNAi active targets from target pests, expanded pests and no target insects. Homologous sequences of selected RNAi actives were identified from transcriptome analyses of Western corn rootworm (WCRW, *Diabrotica virgifera*), Northern corn rootworm (NCRW, *Diabrotica barberi*), Southern corn rootworm (SCRW, *Diabrotica undecimpunctata*), Mexican Bean Beetle (MBB, *Epilachna varivestis*), Colorado potato beetle (CPB, *Leptinotarsa decemlineata*), insidious flower bug (Orius, *Orius insidiosus*) and Spotted Lady Beetle (CMAC, *Coleomegilla maculate*).

FIG. 4 is a graphic showing a sequence alignment of the amino acid sequences of WCRW Ryanr and *Drosophila* Ssk.

DETAILED DESCRIPTION OF THE INVENTION

Figure 5:
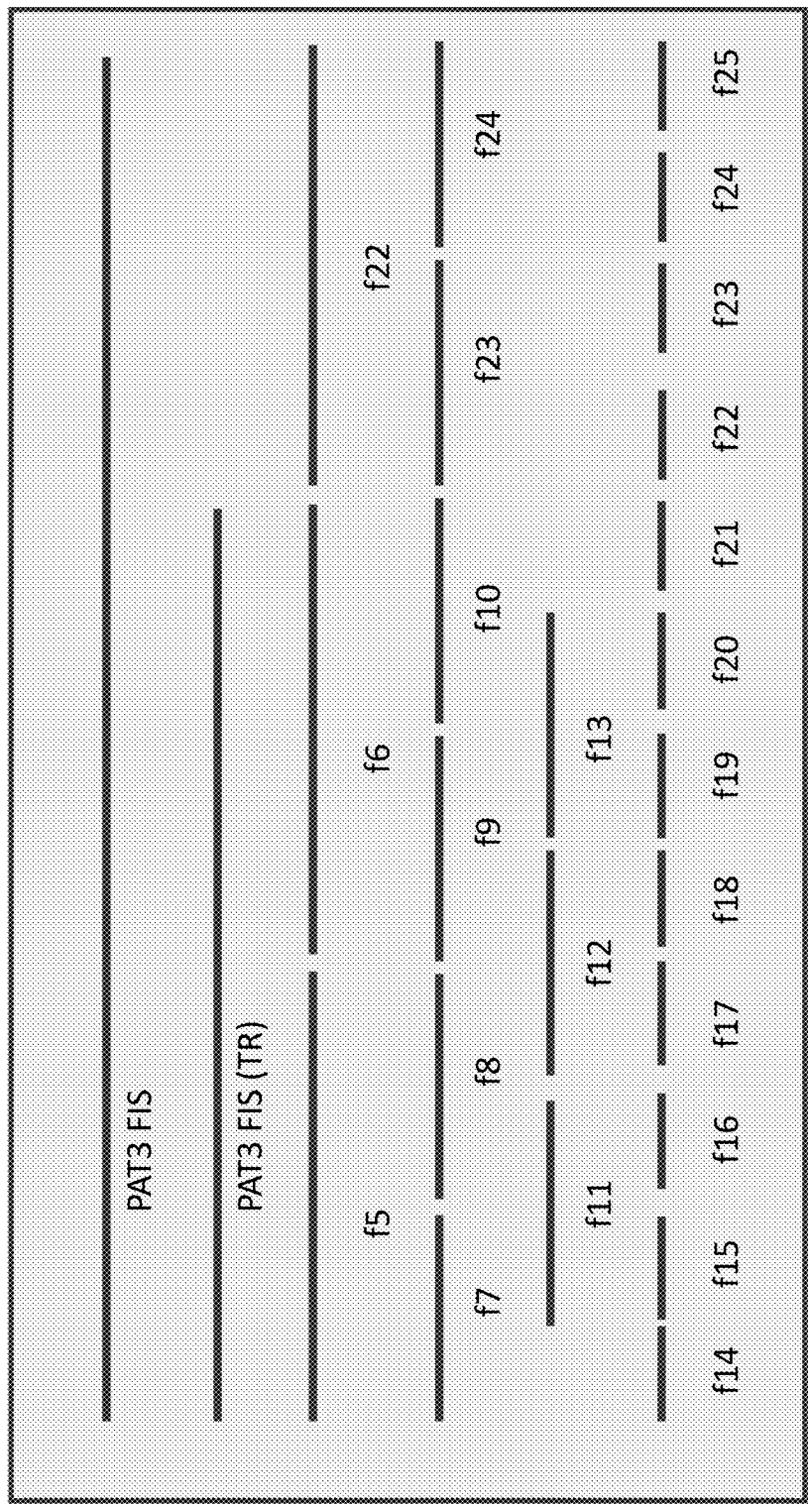
FIG. 5 is a schematic of PAT3 fragments used in the gene and construct optimization experiment.

The present inventions now will be described more fully hereinafter with reference to the accompanying drawings, in which some, but not all embodiments of the inventions are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

I. Overview

Frequently, RNAi discovery methods rely on evaluation of known classes of sensitive genes (transcription factors, housekeeping genes etc.). In contrast, the target polynucleotides set forth herein were identified based solely on high throughput screens of all singletons and representatives of all gene clusters from a cDNA library of neonate and/or 3$^{rd}$ instar midgut western corn rootworms. This screen allowed for the discovery of many novel sequences, many of which have extremely low or no homology to known sequences. This method provided the advantage of having no built in bias to genes that are frequently highly conserved across taxa. As a result, many novel targets for RNAi as well as known genes not previously shown to be sensitive to RNAi have been identified.

As such, methods and compositions are provided which employ one or more silencing elements that, when ingested by a pest, such as a Coleopteran plant pest or a *Diabrotica* plant pest, is capable of decreasing the expression of a target sequence in the pest. In specific embodiments, the decrease in expression of the target sequence controls the pest and thereby the methods and compositions are capable of limiting damage to a plant or plant part. The present invention provides target polynucleotides as set forth in SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof. Silencing elements comprising sequences, complementary sequences, active fragments or variants of these target polynucleotides are provided which, when ingested by or when contacting the pest, decrease the expression of one or more of the target sequences and thereby controls the pest (i.e., has insecticidal activity).

As used herein, by "controlling a pest" or "controls a pest" is intended any affect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack, or deterring the pests from eating the plant.

Reducing the level of expression of the target polynucleotide or the polypeptide encoded thereby, in the pest results in the suppression, control, and/or killing the invading pest. Reducing the level of expression of the target sequence of the pest will reduce the pest damage by at least about 2% to at least about 6%, at least about 5% to about 50%, at least about 10% to about 60%, at least about 30% to about 70%, at least about 40% to about 80%, or at least about 50% to about 90% or greater. Hence, the methods of the invention can be utilized to control pests, particularly, Coleopteran plant pests or a *Diabrotica* plant pest.

Assays measuring the control of a pest are commonly known in the art, as are methods to record nodal injury score. See, for example, Oleson et al. (2005) J. Econ. Entomol. 98:1-8. See, for example, the examples below.

The invention is drawn to compositions and methods for protecting plants from a plant pest, such as Coleopteran plant pests or *Diabrotica* plant pests or inducing resistance in a plant to a plant pest, such as Coleopteran plant pests or *Diabrotica* plant pests. As used herein "Coleopteran plant pest" is used to refer to any member of the Coleoptera order. Other plant pests that may be targeted by the methods and compositions of the present invention include, but are not limited to Mexican Bean Beetle (*Epilachna varivestis*), and Colorado potato beetle (*Leptinotarsa decemlineata*), As used herein, the term "*Diabrotica* plant pest" is used to refer to any member of the *Diabrotica* genus. Accordingly, the compositions and methods are also useful in protecting plants against any *Diabrotica* plant pest including, for example, *Diabrotica adelpha; Diabrotica amecameca; Diabrotica balteata; Diabrotica barberi; Diabrotica biannularis; Diabrotica cristata; Diabrotica decempunctata; Diabrotica dissimilis; Diabrotica lemniscata; Diabrotica limitata* (including, for example, *Diabrotica limitata quindecimpunctata*); *Diabrotica longicornis; Diabrotica nummularis; Diabrotica porracea; Diabrotica scutellata; Diabrotica sexmaculata; Diabrotica speciosa* (including, for example, *Diabrotica speciosa speciosa*); *Diabrotica tibialis; Diabrotica undecimpunctata* (including, for example, Southern corn rootworm (*Diabrotica undecimpunctata*), *Diabrotica undecimpunctata duodecimnotata; Diabrotica undecimpunctata howardi* (spotted cucumber beetle); *Diabrotica undecimpunctata undecimpunctata* (western spotted cucumber beetle)); *Diabrotica virgifera* (including, for example, *Diabrotica virgifera virgifera* (western corn rootworm) and *Diabrotica virgifera zeae* (Mexican corn rootworm)); *Diabrotica viridula; Diabrotica wartensis; Diabrotica* sp. JJG335; *Diabrotica* sp. JJG336; *Diabrotica* sp. JJG341; *Diabrotica* sp. JJG356; *Diabrotica* sp. JJG362; and, *Diabrotica* sp. JJG365.

In specific embodiments, the *Diabrotica* plant pest comprises *D. virgifera virgifera, D. barberi, D. virgifera zeae, D. speciosa, D. speciosa* or *D. undecimpunctata howardi*.

II. Target Sequences

As used herein, a "target sequence" or "target polynucleotide" comprises any sequence in the pest that one desires to reduce the level of expression thereof. In specific embodiments, decreasing the level of the target sequence in the pest controls the pest. For instance, the target sequence may be essential for growth and development. While the target sequence can be expressed in any tissue of the pest, in specific embodiments, the sequences targeted for suppression in the pest are expressed in cells of the gut tissue of the pest, cells in the midgut of the pest, and cells lining the gut lumen or the midgut. Such target sequences can be involved in, for example, gut cell metabolism, growth or differentiation. Non-limiting examples of target sequences of the invention include a polynucleotide set forth in SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof. As exemplified elsewhere herein, decreasing the level of expression of one or more of these target sequences in a Coleopteran plant pest or a *Diabrotica* plant pest controls the pest.

III. Silencing Elements

By "silencing element" is intended a polynucleotide which when contacted by or ingested by a pest, is capable of reducing or eliminating the level or expression of a target polynucleotide or the polypeptide encoded thereby. The silencing element employed can reduce or eliminate the expression level of the target sequence by influencing the level of the target RNA transcript or, alternatively, by influencing translation and thereby affecting the level of the encoded polypeptide. Methods to assay for functional silencing elements that are capable of reducing or eliminating the level of a sequence of interest are disclosed elsewhere herein. A single polynucleotide employed in the methods of the invention can comprise one or more silencing elements to the same or different target polynucleotides. The silencing element can be produced in vivo (i.e., in a host cell such as a plant or microorganism) or in vitro.

In specific embodiments, the target sequence is not endogenous to the plant. In other embodiments, while the silencing element controls pests, preferably the silencing element has no effect on the normal plant or plant part.

As discussed in further detail below, silencing elements can include, but are not limited to, a sense suppression element, an antisense suppression element, a double stranded RNA, a siRNA, a amiRNA, a miRNA, or a hairpin suppression element. Silencing elements of the present invention may comprise a chimera where two or more sequences of the present invention or active fragments or variants, or complements thereof, are found in the same RNA molecule. Further, a sequence of the present invention or active fragment or variant, or complement thereof, may be present as more than one copy in a DNA construct, silencing element, DNA molecule or RNA molecule. In a hairpin or dsRNA molecule, the location of a sense or antisense sequence in the molecule, for example, in which sequence is transcribed first or is located on a particular terminus of the RNA molecule, is not limiting to the invention, and the invention is not to be limited by disclosures herein of a particular location for such a sequence. Non-limiting examples of silencing elements that can be employed to decrease expression of these target Coleopteran plant pest sequences or *Diabrotica* plant pest sequences comprise fragments and variants of the sense or antisense sequence or consists of the sense or antisense sequence of the sequence set forth in SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof. The silencing element can further comprise additional sequences that advantageously effect transcription and/or the stability of a resulting transcript. For example, the silencing elements can comprise at least one thymine residue at the 3' end. This can aid in stabilization. Thus, the silencing elements can have at least 1, 2, 3, 4, 5, 6, 7, 8, 9, 10 or more thymine residues at the 3' end. As discussed in further detail below, enhancer suppressor elements can also be employed in conjunction with the silencing elements disclosed herein.

By "reduces" or "reducing" the expression level of a polynucleotide or a polypeptide encoded thereby is intended to mean, the polynucleotide or polypeptide level of the target sequence is statistically lower than the polynucleotide level or polypeptide level of the same target sequence in an appropriate control pest which is not exposed to (i.e., has not ingested or come into contact with) the silencing element. In particular embodiments of the invention, reducing the polynucleotide level and/or the polypeptide level of the target sequence in a pest according to the invention results in less than 95%, less than 90%, less than 80%, less than 70%, less than 60%, less than 50%, less than 40%, less than 30%, less than 20%, less than 10%, or less than 5% of the polynucleotide level, or the level of the polypeptide encoded thereby, of the same target sequence in an appropriate control pest. Methods to assay for the level of the RNA transcript, the level of the encoded polypeptide, or the activity of the polynucleotide or polypeptide are discussed elsewhere herein.

i. Sense Suppression Elements

As used herein, a "sense suppression element" comprises a polynucleotide designed to express an RNA molecule corresponding to at least a part of a target messenger RNA in the "sense" orientation. Expression of the RNA molecule comprising the sense suppression element reduces or eliminates the level of the target polynucleotide or the polypeptide encoded thereby. The polynucleotide comprising the sense suppression element may correspond to all or part of the sequence of the target polynucleotide, all or part of the 5' and/or 3' untranslated region of the target polynucleotide, all or part of the coding sequence of the target polynucleotide, or all or part of both the coding sequence and the untranslated regions of the target polynucleotide.

Typically, a sense suppression element has substantial sequence identity to the target polynucleotide, typically greater than about 65% sequence identity, greater than about 85% sequence identity, about 90%, 91%, 92%, 93%, 94%, 95%, 96%, 97%, 98% or 99% sequence identity. See, U.S. Pat. Nos. 5,283,184 and 5,034,323; herein incorporated by reference. The sense suppression element can be any length so long as it allows for the suppression of the targeted sequence. The sense suppression element can be, for example, 15, 16, 17, 18, 19, 20, 22, 25, 30, 50, 100, 150, 200, 250, 300, 350, 400, 450, 500, 600, 700, 900, 1000, 1100, 1200, 1300 nucleotides or longer of the target polynucleotides set forth in any of SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof. In other embodiments, the sense suppression element can be, for example, about 15-25, 19-35, 19-50, 25-100, 100-150, 150-200, 200-250, 250-300, 300-350, 350-400, 450-500, 500-550, 550-600, 600-650, 650-700, 700-750, 750-800, 800-850, 850-900, 900-950, 950-1000, 1000-1050, 1050-1100, 1100-1200, 1200-1300, 1300-1400, 1400-1500, 1500-1600, 1600-1700, 1700-1800 nucleotides or longer of the target polynucleotides set forth in any of SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof.

ii. Antisense Suppression Elements

As used herein, an "antisense suppression element" comprises a polynucleotide which is designed to express an RNA molecule complementary to all or part of a target messenger RNA. Expression of the antisense RNA suppression element reduces or eliminates the level of the target polynucleotide. The polynucleotide for use in antisense suppression may correspond to all or part of the complement of the sequence encoding the target polynucleotide, all or part of the complement of the 5' and/or 3' untranslated region of the target polynucleotide, all or part of the complement of the coding sequence of the target polynucleotide, or all or part of the complement of both the coding sequence and the untranslated regions of the target polynucleotide. In addition, the antisense suppression element may be fully complementary (i.e., 100% identical to the complement of the target sequence) or partially complementary (i.e., less than 100% identical to the complement of the target sequence) to the target polynucleotide. In specific embodiments, the antisense suppression element comprises at least 85%, 90%, 91%, 92%, 93%, 94%, 95%, 96%, 97%, 98%, or 99% sequence complementarity to the target polynucleotide. Antisense suppression may be used to inhibit the expression of multiple proteins in the same plant. See, for example, U.S. Pat. No. 5,942,657. Furthermore, the antisense suppression element can be complementary to a portion of the target polynucleotide. Generally, sequences of at least 15, 16, 17, 18, 19, 20, 22, 25, 50, 100, 200, 300, 400, 450 nucleotides or greater of the sequence set forth in any of SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof may be used. Methods for using antisense suppression to inhibit the expression of endogenous genes in plants are described, for example, in Liu et at (2002) *Plant Physiol.* 129:1732-1743 and U.S. Pat. Nos. 5,759,829 and 5,942,657, each of which is herein incorporated by reference.

iii. Double Stranded RNA Suppression Element

A "double stranded RNA silencing element" or "dsRNA" comprises at least one transcript that is capable of forming a dsRNA either before or after ingestion by a pest. Thus, a "dsRNA silencing element" includes a dsRNA, a transcript or polyribonucleotide capable of forming a dsRNA or more than one transcript or polyribonucleotide capable of forming a dsRNA. "Double stranded RNA" or "dsRNA" refers to a polyribonucleotide structure formed either by a single self-complementary RNA molecule or a polyribonucleotide structure formed by the expression of at least two distinct RNA strands. The dsRNA molecule(s) employed in the methods and compositions of the invention mediate the reduction of expression of a target sequence, for example, by mediating RNA interference "RNAi" or gene silencing in a sequence-specific manner. In the context of the present invention, the dsRNA is capable of reducing or eliminating the level or expression of a target polynucleotide or the polypeptide encoded thereby in a pest.

The dsRNA can reduce or eliminate the expression level of the target sequence by influencing the level of the target RNA transcript, by influencing translation and thereby affecting the level of the encoded polypeptide, or by influencing expression at the pre-transcriptional level (i.e., via the modulation of chromatin structure, methylation pattern, etc., to alter gene expression). See, for example, Verdel et al. (2004) *Science* 303:672-676; Pal-Bhadra et al. (2004) *Science* 303:669-672; Allshire (2002) *Science* 297:1818-1819; Volpe et al. (2002) *Science* 297:1833-1837; Jenuwein (2002) *Science* 297:2215-2218; and Hall et al. (2002) *Science* 297:2232-2237. Methods to assay for functional dsRNA that are capable of reducing or eliminating the level of a sequence of interest are disclosed elsewhere herein. Accordingly, as used herein, the term "dsRNA" is meant to encompass other terms used to describe nucleic acid molecules that are capable of mediating RNA interference or gene silencing, including, for example, short-interfering RNA (siRNA), double-stranded RNA (dsRNA), micro-RNA (miRNA), hairpin RNA, short hairpin RNA (shRNA), post-transcriptional gene silencing RNA (ptgsRNA), and others.

In specific embodiments, at least one strand of the duplex or double-stranded region of the dsRNA shares sufficient sequence identity or sequence complementarity to the target polynucleotide to allow for the dsRNA to reduce the level of expression of the target sequence. As used herein, the strand that is complementary to the target polynucleotide is the "antisense strand" and the strand homologous to the target polynucleotide is the "sense strand."

In another embodiment, the dsRNA comprises a hairpin RNA. A hairpin RNA comprises an RNA molecule that is capable of folding back onto itself to form a double stranded structure. Multiple structures can be employed as hairpin elements. In specific embodiments, the dsRNA suppression element comprises a hairpin element which comprises in the following order, a first segment, a second segment, and a third segment, where the first and the third segment share sufficient complementarity to allow the transcribed RNA to form a double-stranded stem-loop structure.

The "second segment" of the hairpin comprises a "loop" or a "loop region." These terms are used synonymously herein and are to be construed broadly to comprise any nucleotide sequence that confers enough flexibility to allow self-pairing to occur between complementary regions of a polynucleotide (i.e., segments 1 and 3 which form the stem of the hairpin). For example, in some embodiments, the loop region may be substantially single stranded and act as a spacer between the self-complementary regions of the hairpin stem-loop. In some embodiments, the loop region can comprise a random or nonsense nucleotide sequence and thus not share sequence identity to a target polynucleotide. In other embodiments, the loop region comprises a sense or an antisense RNA sequence or fragment thereof that shares identity to a target polynucleotide. See, for example, International Patent Publication No. WO 02/00904, herein incorporated by reference. In specific embodiments, the loop region can be optimized to be as short as possible while still providing enough intramolecular flexibility to allow the formation of the base-paired stem region. Accordingly, the loop sequence is generally less than 1000, 900, 800, 700, 600, 500, 400, 300, 200, 100, 50, 25, 20, 19, 18, 17, 16, 15, 10 nucleotides or less.

The "first" and the "third" segment of the hairpin RNA molecule comprise the base-paired stem of the hairpin structure. The first and the third segments are inverted repeats of one another and share sufficient complementarity to allow the formation of the base-paired stem region. In specific embodiments, the first and the third segments are fully complementary to one another. Alternatively, the first and the third segment may be partially complementary to each other so long as they are capable of hybridizing to one another to form a base-paired stem region. The amount of complementarity between the first and the third segment can be calculated as a percentage of the entire segment. Thus, the first and the third segment of the hairpin RNA generally share at least 50%, 60%, 70%, 80%, 85%, 90%, 91%, 92%, 93%, 94%, 95%, 96%, 97%, 98%, 99%, up to and including 100% complementarity.

The first and the third segment are at least about 1000, 500, 475, 450, 425, 400, 375, 350, 325, 300, 250, 225, 200, 175, 150, 125, 100, 75, 60, 50, 40, 30, 25, 22, 20, 19, 18, 17, 16, 15 or 10 nucleotides in length. In specific embodiments, the length of the first and/or the third segment is about 10-100 nucleotides, about 10 to about 75 nucleotides, about 10 to about 50 nucleotides, about 10 to about 40 nucleotides, about 10 to about 35 nucleotides, about 10 to about 30 nucleotides, about 10 to about 25 nucleotides, about 10 to about 19 nucleotides, about 10 to about 20 nucleotides, about 19 to about 50 nucleotides, about 50 nucleotides to about 100 nucleotides, about 100 nucleotides to about 150 nucleotides, about 100 nucleotides to about 300 nucleotides, about 150 nucleotides to about 200 nucleotides, about 200 nucleotides to about 250 nucleotides, about 250 nucleotides to about 300 nucleotides, about 300 nucleotides to about 350 nucleotides, about 350 nucleotides to about 400 nucleotides, about 400 nucleotide to about 500 nucleotides, about 600 nt, about 700 nt, about 800 nt, about 900 nt, about 1000 nt, about 1100 nt, about 1200 nt, 1300 nt, 1400 nt, 1500 nt, 1600 nt, 1700 nt, 1800 nt, 1900 nt, 2000 nt or longer. In other embodiments, the length of the first and/or the third segment comprises at least 10-19 nucleotides, 10-20 nucleotides; 19-35 nucleotides, 20-35 nucleotides; 30-45 nucleotides; 40-50 nucleotides; 50-100 nucleotides; 100-300 nucleotides; about 500-700 nucleotides; about 700-900 nucleotides; about 900-1100 nucleotides; about 1300-1500 nucleotides; about 1500-1700 nucleotides; about 1700-1900 nucleotides; about 1900-2100 nucleotides; about 2100-2300 nucleotides; or about 2300-2500 nucleotides. See, for example, International Publication No. WO 0200904.

Hairpin molecules or double-stranded RNA molecules of the present invention may have more than one sequence of the present invention or active fragments or variants, or complements thereof, found in the same portion of the RNA molecule. For example, in a chimeric hairpin structure, the first segment of a hairpin molecule comprises two polynucleotide sections, each with a different sequence of the present invention. For example, reading from one terminus of the hairpin, the first segment is composed of sequences from two separate genes (A followed by B). This first segment is followed by the second segment, the loop portion of the hairpin. The loop segment is followed by the third segment, where the complementary strands of the sequences in the first segment are found (B* followed by A*) in forming the stem-loop, hairpin structure, the stem contains SeqA-A* at the distal end of the stem and SeqB-B* proximal to the loop region.

In specific embodiments, the first and the third segment comprise at least 20 nucleotides having at least 85% complementary to the first segment. In still other embodiments, the first and the third segments which form the stem-loop structure of the hairpin comprises 3' or 5' overhang regions having unpaired nucleotide residues.

In specific embodiments, the sequences used in the first, the second, and/or the third segments comprise domains that are designed to have sufficient sequence identity to a target polynucleotide of interest and thereby have the ability to decrease the level of expression of the target polynucleotide. The specificity of the inhibitory RNA transcripts is therefore generally conferred by these domains of the silencing element. Thus, in some embodiments of the invention, the first, second and/or third segment of the silencing element comprise a domain having at least 10, at least 15, at least 19, at least 20, at least 21, at least 22, at least 23, at least 24, at least 25, at least 30, at least 40, at least 50, at least 100, at least 200, at least 300, at least 500, at least 1000, or more than 1000 nucleotides that share sufficient sequence identity to the target polynucleotide to allow for a decrease in expression levels of the target polynucleotide when expressed in an appropriate cell. In other embodiments, the domain is between about 15 to 50 nucleotides, about 19-35 nucleotides, about 20-35 nucleotides, about 25-50 nucleotides, about 19 to 75 nucleotides, about 20 to 75 nucleotides, about 40-90 nucleotides about 15-100 nucleotides 10-100 nucleotides, about 10 to about 75 nucleotides, about 10 to about 50 nucleotides, about 10 to about 40 nucleotides, about 10 to about 35 nucleotides, about 10 to about 30 nucleotides, about 10 to about 25 nucleotides, about 10 to about 20 nucleotides, about 10 to about 19 nucleotides, about 50 nucleotides to about 100 nucleotides, about 100 nucleotides to about 150 nucleotides, about 150 nucleotides to about 200 nucleotides, about 200 nucleotides to about 250 nucleotides, about 250 nucleotides to about 300 nucleotides, about 300 nucleotides to about 350 nucleotides, about 350 nucleotides to about 400 nucleotides, about 400 nucleotide to about 500 nucleotides or longer. In other embodiments, the length of the first and/or the third segment comprises at least 10-20 nucleotides, at least 10-19 nucleotides, 20-35 nucleotides, 30-45 nucleotides, 40-50 nucleotides, 50-100 nucleotides, or about 100-300 nucleotides.

In specific embodiments, the domain of the first, the second, and/or the third segment has 100% sequence identity to the target polynucleotide. In other embodiments, the domain of the first, the second and/or the third segment having homology to the target polypeptide have at least 50%, 60%, 70%, 80%, 85%, 90%, 91%, 92%, 93%, 94%, 95%, 96%, 97%, 98%, 99%, or greater sequence identity to a region of the target polynucleotide. The sequence identity of the domains of the first, the second and/or the third segments to the target polynucleotide need only be sufficient to decrease expression of the target polynucleotide of interest. See, for example, Chuang and Meyerowitz (2000) *Proc. Natl. Acad. Sci. USA* 97:4985-4990; Stoutjesdijk et al. (2002) *Plant Physiol.* 129:1723-1731; Waterhouse and Helliwell (2003) *Nat. Rev. Genet.* 4:29-38; Pandolfini et al. *BMC Biotechnology* 3:7, and U.S. Patent Publication No. 20030175965; each of which is herein incorporated by reference. A transient assay for the efficiency of hpRNA constructs to silence gene expression in vivo has been described by Panstruga et al. (2003) *Mol. Biol. Rep.* 30:135-140, herein incorporated by reference.

The amount of complementarity shared between the first, second, and/or third segment and the target polynucleotide or the amount of complementarity shared between the first segment and the third segment (i.e., the stem of the hairpin structure) may vary depending on the organism in which gene expression is to be controlled. Some organisms or cell types may require exact pairing or 100% identity, while other organisms or cell types may tolerate some mismatching. In some cells, for example, a single nucleotide mismatch in the targeting sequence abrogates the ability to suppress gene expression. In these cells, the suppression cassettes of the invention can be used to target the suppression of mutant genes, for example, oncogenes whose transcripts comprise point mutations and therefore they can be specifically targeted using the methods and compositions of the invention without altering the expression of the remaining wild-type allele. In other organisms, holistic sequence variability may be tolerated as long as some 22 nt region of the sequence is represented in 100% homology between target polynucleotide and the suppression cassette.

Any region of the target polynucleotide can be used to design the domain of the silencing element that shares sufficient sequence identity to allow expression of the hairpin transcript to decrease the level of the target polynucleotide. For instance, the domain can be designed to share sequence identity to the 5' untranslated region of the target polynucleotide(s), the 3' untranslated region of the target polynucleotide(s), exonic regions of the target polynucleotide(s), intronic regions of the target polynucleotide(s), and any combination thereof. In specific embodiments, a domain of the silencing element shares sufficient homology to at least about 15, 16, 17, 18, 19, 20, 22, 25 or 30 consecutive nucleotides from about nucleotides 1-50, 25-75, 75-125, 50-100, 125-175, 175-225, 100-150, 150-200, 200-250, 225-275, 275-325, 250-300, 325-375, 375-425, 300-350, 350-400, 425-475, 400-450, 475-525, 450-500, 525-575, 575-625, 550-600, 625-675, 675-725, 600-650, 625-675, 675-725, 650-700, 725-825, 825-875, 750-800, 875-925, 925-975, 850-900, 925-975, 975-1025, 950-1000, 1000-1050, 1025-1075, 1075-1125, 1050-1100, 1125-1175, 1100-1200, 1175-1225, 1225-1275, 1200-1300, 1325-1375, 1375-1425, 1300-1400, 1425-1475, 1475-1525, 1400-1500, 1525-1575, 1575-1625, 1625-1675, 1675-1725, 1725-1775, 1775-1825, 1825-1875, 1875-1925, 1925-1975, 1975-2025, 2025-2075, 2075-2125, 2125-2175, 2175-2225, 1500-1600, 1600-1700, 1700-1800, 1800-1900, 1900-2000 of the target sequence. In some instances to optimize the siRNA sequences employed in the hairpin, the synthetic oligodeoxyribonucleotide/RNAse H method can be used to determine sites on the target mRNA that are in a conformation that is susceptible to RNA silencing. See, for example, Vickers et al. (2003) *J. Biol. Chem.* 278:7108-7118 and Yang et al. (2002) *Proc. Natl. Acad. Sci. USA* 99:9442-9447, herein incorporated by reference. These studies indicate that there is a significant correlation between the RNase-H-sensitive sites and sites that promote efficient siRNA-directed mRNA degradation.

The hairpin silencing element may also be designed such that the sense sequence or the antisense sequence do not correspond to a target polynucleotide. In this embodiment, the sense and antisense sequence flank a loop sequence that comprises a nucleotide sequence corresponding to all or part of the target polynucleotide. Thus, it is the loop region that determines the specificity of the RNA interference. See, for example, WO 02/00904, herein incorporated by reference.

In addition, transcriptional gene silencing (TGS) may be accomplished through use of a hairpin suppression element where the inverted repeat of the hairpin shares sequence identity with the promoter region of a target polynucleotide to be silenced. See, for example, Aufsatz et al. (2002) PNAS 99 (Suppl. 4):16499-16506 and Mette et al. (2000) EMBO J19(19):5194-5201.

In other embodiments, the silencing element can comprise a small RNA (sRNA). sRNAs can comprise both micro RNA (miRNA) and short-interfering RNA (siRNA) (Meister and Tuschl (2004) *Nature* 431:343-349 and Bonetta et al. (2004) *Nature Methods* 1:79-86). miRNAs are regulatory agents comprising about 19 to about 24 ribonucleotides in length which are highly efficient at inhibiting the expression of target polynucleotides. See, for example Javier et al. (2003) *Nature* 425: 257-263, herein incorporated by reference. For miRNA interference, the silencing element can be designed to express a dsRNA molecule that forms a hairpin structure or partially base-paired structure containing 19, 20, 21, 22, 23, 24 or 25-nucleotide sequence that is complementary to the target polynucleotide of interest. The miRNA can be synthetically made, or transcribed as a longer RNA which is subsequently cleaved to produce the active miRNA. Specifically, the miRNA can comprise 19 nucleotides of the sequence having homology to a target polynucleotide in sense orientation and 19 nucleotides of a corresponding antisense sequence that is complementary to the sense sequence. The miRNA can be an "artificial miRNA" or "amiRNA" which comprises a miRNA sequence that is synthetically designed to silence a target sequence.

When expressing an miRNA the final (mature) miRNA is present in a duplex in a precursor backbone structure, the two strands being referred to as the miRNA (the strand that will eventually basepair with the target) and miRNA*(star sequence). It has been demonstrated that miRNAs can be transgenically expressed and target genes of interest efficiently silenced (Highly specific gene silencing by artificial microRNAs in *Arabidopsis* Schwab R, Ossowski S, Riester M, Warthmann N, Weigel D. Plant Cell. 2006 May; 18(5): 1121-33. Epub 2006 Mar. 10 & Expression of artificial microRNAs in transgenic *Arabidopsis thaliana* confers virus resistance. Niu Q W, Lin S S, Reyes J L, Chen K C, Wu H W, Yeh S D, Chua N H. Nat. Biotechnol. 2006 Nov.; 24(11):1420-8. Epub 2006 Oct. 22. Erratum in: Nat. Biotechnol. 2007 Feb.; 25(2):254.)

The silencing element for miRNA interference comprises a miRNA primary sequence. The miRNA primary sequence comprises a DNA sequence having the miRNA and star sequences separated by a loop as well as additional sequences flanking this region that are important for processing. When expressed as an RNA, the structure of the primary miRNA is such as to allow for the formation of a hairpin RNA structure that can be processed into a mature miRNA. In some embodiments, the miRNA backbone comprises a genomic or cDNA miRNA precursor sequence, wherein said sequence comprises a native primary in which a heterologous (artificial) mature miRNA and star sequence are inserted.

As used herein, a "star sequence" is the sequence within a miRNA precursor backbone that is complementary to the miRNA and forms a duplex with the miRNA to form the stem structure of a hairpin RNA. In some embodiments, the star sequence can comprise less than 100% complementarity to the miRNA sequence. Alternatively, the star sequence can comprise at least 99%, 98%, 97%, 96%, 95%, 90%, 85%, 80% or lower sequence complementarity to the miRNA sequence as long as the star sequence has sufficient complementarity to the miRNA sequence to form a double stranded structure. In still further embodiments, the star sequence comprises a sequence having 1, 2, 3, 4, 5 or more mismatches with the miRNA sequence and still has sufficient complementarity to form a double stranded structure with the miRNA sequence resulting in production of miRNA and suppression of the target sequence.

The miRNA precursor backbones can be from any plant. In some embodiments, the miRNA precursor backbone is from a monocot. In other embodiments, the miRNA precursor backbone is from a dicot. In further embodiments, the backbone is from maize or soybean. MicroRNA precursor backbones have been described previously. For example, US20090155910A1 (WO 2009/079532) discloses the following soybean miRNA precursor backbones: 156c, 159, 166b, 168c, 396b and 398b, and US20090155909A1 (WO 2009/079548) discloses the following maize miRNA precursor backbones: 159c, 164h, 168a, 169r, and 396h. Each of these references is incorporated by reference in their entirety.

Thus, the primary miRNA can be altered to allow for efficient insertion of heterologous miRNA and star sequences within the miRNA precursor backbone. In such instances, the miRNA segment and the star segment of the miRNA precursor backbone are replaced with the heterologous miRNA and the heterologous star sequences, designed to target any sequence of interest, using a PCR technique and cloned into an expression construct. It is recognized that there could be alterations to the position at which the artificial miRNA and star sequences are inserted into the backbone. Detailed methods for inserting the miRNA and star sequence into the miRNA precursor backbone are described in, for example, US Patent Applications 20090155909A1 and US20090155910A1, herein incorporated by reference in their entirety.

When designing a miRNA sequence and star sequence, various design choices can be made. See, for example, Schwab R, et al. (2005) Dev Cell 8: 517-27. In non-limiting embodiments, the miRNA sequences disclosed herein can have a "U" at the 5'-end, a "C" or "G" at the 19th nucleotide position, and an "A" or "U" at the 10th nucleotide position. In other embodiments, the miRNA design is such that the miRNA have a high free delta-G as calculated using the ZipFold algorithm (Markham, N. R. & Zuker, M. (2005) Nucleic Acids Res. 33: W577-W581.) Optionally, a one base pair change can be added within the 5' portion of the miRNA so that the sequence differs from the target sequence by one nucleotide.

The methods and compositions of the invention employ silencing elements that when transcribed "form" a dsRNA molecule. Accordingly, the heterologous polynucleotide being expressed need not form the dsRNA by itself, but can interact with other sequences in the plant cell or in the pest gut after ingestion to allow the formation of the dsRNA. For example, a chimeric polynucleotide that can selectively silence the target polynucleotide can be generated by expressing a chimeric construct comprising the target sequence for a miRNA or siRNA to a sequence corresponding to all or part of the gene or genes to be silenced. In this embodiment, the dsRNA is "formed" when the target for the miRNA or siRNA interacts with the miRNA present in the cell. The resulting dsRNA can then reduce the level of expression of the gene or genes to be silenced. See, for example, US Application Publication 2007-0130653, entitled "Methods and Compositions for Gene Silencing", herein incorporated by reference. The construct can be designed to have a target for an endogenous miRNA or alternatively, a target for a heterologous and/or synthetic miRNA can be employed in the construct. If a heterologous and/or synthetic miRNA is employed, it can be introduced into the cell on the same nucleotide construct as the chimeric polynucleotide or on a separate construct. As discussed elsewhere herein, any method can be used to introduce the construct comprising the heterologous miRNA.

e. Silencing Elements

A silencing element may comprise a chimeric construction molecule comprising two or more sequences of the present invention. For example, the chimeric construction may be a hairpin or dsRNA as disclosed herein. A chimera may comprise two or more sequences of the present invention. Providing at least two different sequences in a single silencing element may allow for targeting multiple genes using one silencing element and/or for example, one expression cassette.

Targeting multiple genes may allow for slowing or reducing the possibility of resistance by the pest, and providing the multiple targeting ability in one expressed molecule may reduce the expression burden of the transformed plant or plant product, or provide topical treatments that are capable of targeting multiple hosts with one application.

IV. Variants and Fragments

By "fragment" is intended a portion of the polynucleotide or a portion of the amino acid sequence and hence protein encoded thereby. Fragments of a polynucleotide may encode protein fragments that retain the biological activity of the native protein. Alternatively, fragments of a polynucleotide that are useful as a silencing element do not need to encode fragment proteins that retain biological activity. Thus, fragments of a nucleotide sequence may range from at least about 10, about 15, about 16, about 17, about 18, about 19, nucleotides, about 20 nucleotides, about 22 nucleotides, about 50 nucleotides, about 75 nucleotides, about 100 nucleotides, 200 nucleotides, 300 nucleotides, 400 nucleotides, 500 nucleotides, 600 nucleotides, 700 nucleotides and up to the full-length polynucleotide employed in the invention. Alternatively, fragments of a nucleotide sequence may range from 1-50, 25-75, 75-125, 50-100, 125-175, 175-225, 100-150, 100-300, 150-200, 200-250, 225-275, 275-325, 250-300, 325-375, 375-425, 300-350, 350-400, 425-475, 400-450, 475-525, 450-500, 525-575, 575-625, 550-600, 625-675, 675-725, 600-650, 625-675, 675-725, 650-700, 725-825, 825-875, 750-800, 875-925, 925-975, 850-900, 925-975, 975-1025, 950-1000, 1000-1050, 1025-1075, 1075-1125, 1050-1100, 1125-1175, 1100-1200, 1175-1225, 1225-1275, 1200-1300, 1325-1375, 1375-1425, 1300-1400, 1425-1475, 1475-1525, 1400-1500, 1525-1575, 1575-1625, 1625-1675, 1675-1725, 1725-1775, 1775-1825, 1825-1875, 1875-1925, 1925-1975, 1975-2025, 2025-2075, 2075-2125, 2125-2175, 2175-2225, 1500-1600, 1600-1700, 1700-1800, 1800-1900, 1900-2000 of any one of SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof. Methods to assay for the activity of a desired silencing element are described elsewhere herein.

"Variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. A variant of a polynucleotide that is useful as a silencing element will retain the ability to reduce expression of the target polynucleotide and, in some embodiments, thereby control a pest of interest. As used herein, a "native" polynucleotide or polypeptide comprises a naturally occurring nucleotide sequence or amino acid sequence, respectively. For polynucleotides, conservative variants include those sequences that, because of the degeneracy of the genetic code, encode the amino acid sequence of one of the polypeptides employed in the invention. Variant polynucleotides also include synthetically derived polynucleotide, such as those generated, for example, by using site-directed mutagenesis, but continue to retain the desired activity. Generally, variants of a particular polynucleotide of the invention (i.e., a silencing element) will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

Variants of a particular polynucleotide of the invention (i.e., the reference polynucleotide) can also be evaluated by comparison of the percent sequence identity between the polypeptide encoded by a variant polynucleotide and the polypeptide encoded by the reference polynucleotide. Percent sequence identity between any two polypeptides can be calculated using sequence alignment programs and parameters described elsewhere herein. Where any given pair of polynucleotides employed in the invention is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

The following terms are used to describe the sequence relationships between two or more polynucleotides or polypeptides: (a) "reference sequence", (b) "comparison window", (c) "sequence identity", and, (d) "percentage of sequence identity."

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two polynucleotides. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

(c) As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

A method is further provided for identifying a silencing element from the target polynucleotides set forth in SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof. Such methods comprise obtaining a candidate fragment of any one of SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof, which is of sufficient length to act as a silencing element and thereby reduce the expression of the target polynucleotide and/or control a desired pest; expressing said candidate polynucleotide fragment in an appropriate expression cassette to produce a candidate silencing element and determining is said candidate polynucleotide fragment has the activity of a silencing element and thereby reduce the expression of the target polynucleotide and/or controls a desired pest. Methods of identifying such candidate fragments based on the desired pathway for suppression are known. For example, various bioinformatics programs can be employed to identify the region of the target polynucleotides that could be exploited to generate a silencing element. See, for example, Elbahir et al. (2001) *Genes and Development* 15:188-200, Schwartz et al. (2003) *Cell* 115:199-208, Khvorova et al. (2003) *Cell* 115:209-216. See also, siRNA at Whitehead (jura.wi.mit.edu/bioc/siRNAext/) which calculates the binding energies for both sense and antisense siRNAs. See, also genscript.com/ssl-bin/app/rnai?op=known; Block-iT™ RNAi designer from Invitrogen and GenScript siRNA Construct Builder.

V. DNA Constructs

The use of the term "polynucleotide" is not intended to limit the present invention to polynucleotides comprising DNA. Those of ordinary skill in the art will recognize that polynucleotides can comprise ribonucleotides and combinations of ribonucleotides and deoxyribonucleotides. Such deoxyribonucleotides and ribonucleotides include both naturally occurring molecules and synthetic analogues. The polynucleotides of the invention also encompass all forms of sequences including, but not limited to, single-stranded forms, double-stranded forms, hairpins, stem-and-loop structures, and the like.

The polynucleotide encoding the silencing element or in specific embodiments employed in the methods and compositions of the invention can be provided in expression cassettes for expression in a plant or organism of interest. It is recognized that multiple silencing elements including multiple identical silencing elements, multiple silencing elements targeting different regions of the target sequence, or multiple silencing elements from different target sequences can be used. In this embodiment, it is recognized that each silencing element can be contained in a single or separate cassette, DNA construct, or vector. As discussed, any means of providing the silencing element is contemplated. A plant or plant cell can be transformed with a single cassette comprising DNA encoding one or more silencing elements or separate cassettes comprising each silencing element can be used to transform a plant or plant cell or host cell. Likewise, a plant transformed with one component can be subsequently transformed with the second component. One or more silencing elements can also be brought together by sexual crossing. That is, a first plant comprising one component is crossed with a second plant comprising the second component. Progeny plants from the cross will comprise both components.

The expression cassette can include 5' and 3' regulatory sequences operably linked to the polynucleotide of the invention. "Operably linked" is intended to mean a functional linkage between two or more elements. For example, an operable linkage between a polynucleotide of the invention and a regulatory sequence (i.e., a promoter) is a functional link that allows for expression of the polynucleotide of the invention. Operably linked elements may be contiguous or non-contiguous. When used to refer to the joining of two protein coding regions, by operably linked is intended that the coding regions are in the same reading frame. The cassette may additionally contain at least one additional polynucleotide to be cotransformed into the organism. Alternatively, the additional polypeptide(s) can be provided on multiple expression cassettes. Expression cassettes can be provided with a plurality of restriction sites and/or recombination sites for insertion of the polynucleotide to be under the transcriptional regulation of the regulatory regions. The expression cassette may additionally contain selectable marker genes.

The expression cassette can include in the 5'-3' direction of transcription, a transcriptional and translational initiation region (i.e., a promoter), a polynucleotide comprising the silencing element employed in the methods and compositions of the invention, and a transcriptional and translational termination region (i.e., termination region) functional in plants. In other embodiment, the double stranded RNA is expressed from a suppression cassette. Such a cassette can comprise two convergent promoters that drive transcription of an operably linked silencing element. "Convergent promoters" refers to promoters that are oriented on either terminus of the operably linked silencing element such that each promoter drives transcription of the silencing element in opposite directions, yielding two transcripts. In such embodiments, the convergent promoters allow for the transcription of the sense and anti-sense strand and thus allow for the formation of a dsRNA.

The regulatory regions (i.e., promoters, transcriptional regulatory regions, and translational termination regions) and/or the polynucleotides employed in the invention may be native/analogous to the host cell or to each other. Alternatively, the regulatory regions and/or the polynucleotide employed in the invention may be heterologous to the host cell or to each other. As used herein, "heterologous" in reference to a sequence is a sequence that originates from a foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide. As used herein, a chimeric gene comprises a coding sequence operably linked to a transcription initiation region that is heterologous to the coding sequence.

The termination region may be native with the transcriptional initiation region, may be native with the operably linked polynucleotide encoding the silencing element, may be native with the plant host, or may be derived from another source (i.e., foreign or heterologous) to the promoter, the polynucleotide comprising silencing element, the plant host, or any combination thereof. Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The polynucleotide encoding the silencing element can be combined with constitutive, tissue-preferred, or other promoters for expression in plants.

Such constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

An inducible promoter, for instance, a pathogen-inducible promoter could also be employed. Such promoters include those from pathogenesis-related proteins (PR proteins), which are induced following infection by a pathogen; e.g., PR proteins, SAR proteins, beta-1,3-glucanase, chitinase, etc. See, for example, Redolfi et al. (1983) *Neth. J. Plant Pathol.* 89:245-254; Uknes et al. (1992) *Plant Cell* 4:645-656; and Van Loon (1985) *Plant Mol. Virol.* 4:111-116. See also WO 99/43819, herein incorporated by reference.

Additionally, as pathogens find entry into plants through wounds or insect damage, a wound-inducible promoter may be used in the constructions of the invention. Such wound-inducible promoters include potato proteinase inhibitor (pin II) gene (Ryan (1990) *Ann. Rev. Phytopath.* 28:425-449; Duan et al. (1996) *Nature Biotechnology* 14:494-498); wun1 and wun2, U.S. Pat. No. 5,428,148; win1 and win2 (Stanford et al. (1989) *Mol. Gen. Genet.* 215:200-208); systemin (McGurl et al. (1992) *Science* 225:1570-1573); WIP1 (Rohmeier et al. (1993) *Plant Mol. Biol.* 22:783-792; Eckelkamp et al. (1993) *FEBS Letters* 323:73-76); MPI gene (Corderok et al. (1994) *Plant J.* 6(2):141-150); and the like, herein incorporated by reference.

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced expression within a particular plant tissue. Tissue-preferred promoters include Yamamoto et al. (1997) *Plant J.* 12(2):255-265; Kawamata et al. (1997) *Plant Cell Physiol.* 38(7):792-803; Hansen et al. (1997) *Mol. Gen. Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol. Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

Root-preferred promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agro-* bacterium tumefaciens); and Miao et al. (1991) Plant Cell 3(1):11-22 (full-length cDNA clone encoding cytosolic glutamine synthetase (GS), which is expressed in roots and root nodules of soybean). See also Bogusz et al. (1990) Plant Cell 2(7):633-641, where two root-specific promoters isolated from hemoglobin genes from the nitrogen-fixing nonlegume Parasponia andersonii and the related non-nitrogen-fixing nonlegume Trema tomentosa are described. The promoters of these genes were linked to a β-glucuronidase reporter gene and introduced into both the nonlegume Nicotiana tabacum and the legume Lotus corniculatus, and in both instances root-specific promoter activity was preserved. Leach and Aoyagi (1991) describe their analysis of the promoters of the highly expressed rolC and rolD root-inducing genes of Agrobacterium rhizogenes (see Plant Science (Limerick) 79(1):69-76). They concluded that enhancer and tissue-preferred DNA determinants are dissociated in those promoters. Teeri et al. (1989) used gene fusion to lacZ to show that the Agrobacterium T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see EMBO J. 8(2): 343-350). The TR1' gene, fused to nptII (neomycin phosphotransferase II) showed similar characteristics. Additional root-preferred promoters include the VfENOD-GRP3 gene promoter (Kuster et al. (1995) Plant Mol. Biol. 29(4):759-772); and rolB promoter (Capana et al. (1994) Plant Mol. Biol. 25(4):681-691. See also U.S. Pat. Nos. 5,837,876; 5,750,386; 5,633,363; 5,459,252; 5,401,836; 5,110,732; and 5,023,179.

In one embodiment of this invention the plant-expressed promoter is a vascular-specific promoter such as a phloem-specific promoter. A "vascular-specific" promoter, as used herein, is a promoter which is at least expressed in vascular cells, or a promoter which is preferentially expressed in vascular cells. Expression of a vascular-specific promoter need not be exclusively in vascular cells, expression in other cell types or tissues is possible. A "phloem-specific promoter" as used herein, is a plant-expressible promoter which is at least expressed in phloem cells, or a promoter which is preferentially expressed in phloem cells.

Expression of a phloem-specific promoter need not be exclusively in phloem cells, expression in other cell types or tissues, e.g., xylem tissue, is possible. In one embodiment of this invention, a phloem-specific promoter is a plant-expressible promoter at least expressed in phloem cells, wherein the expression in non-phloem cells is more limited (or absent) compared to the expression in phloem cells. Examples of suitable vascular-specific or phloem-specific promoters in accordance with this invention include but are not limited to the promoters selected from the group consisting of: the SCSV3, SCSV4, SCSV5, and SCSV7 promoters (Schunmann et al. (2003) Plant Functional Biology 30:453-60; the rolC gene promoter of Agrobacterium rhizogenes(Kiyokawa et al. (1994) Plant Physiology 104:801-02; Pandolfini et al. (2003) BioMedCentral (BMC) Biotechnology 3:7, Graham et al. (1997) Plant Mol. Biol. 33:729-35; Guivarc'h et al. (1996); Almon et al. (1997) Plant Physiol. 115:1599-607; the rolA gene promoter of Agrobacterium rhizogenes (Dehio et al. (1993) Plant Mol. Biol. 23:1199-210); the promoter of the Agrobacterium tumefaciens T-DNA gene 5 (Korber et al. (1991) EMBO J. 10:3983-91); the rice sucrose synthase RSs1 gene promoter (Shi et al. (1994) J. Exp. Bot. 45:623-31); the CoYMV or Commelina yellow mottle badnavirus promoter (Medberry et al. (1992) Plant Cell 4:185-92; Zhou et al. (1998) Chin. J. Biotechnol. 14:9-16); the CFDV or coconut foliar decay virus promoter (Rohde et al. (1994) Plant Mol. Biol. 27:623-28; Hehn and Rhode (1998) J. Gen. Virol. 79:1495-99); the RTBV or rice tungro bacilliform virus promoter (Yin and Beachy (1995) Plant J. 7:969-80; Yin et al. (1997) Plant J. 12:1179-80); the pea glutamin synthase GS3A gene (Edwards et al. (1990) Proc. Natl. Acad. Sci. USA 87:3459-63; Brears et al. (1991) Plant J. 1:235-44); the inv CD111 and inv CD141 promoters of the potato invertase genes (Hedley et al. (2000) J. Exp. Botany 51:817-21); the promoter isolated from Arabidopsis shown to have phloem-specific expression in tobacco by Kertbundit et al. (1991) Proc. Natl. Acad. Sci. USA 88:5212-16); the VAHOX1 promoter region (Torero et al. (1996) Plant J. 9:639-48); the pea cell wall invertase gene promoter (Zhang et al. (1996) Plant Physiol. 112:1111-17); the promoter of the endogenous cotton protein related to chitinase of US published patent application 20030106097, an acid invertase gene promoter from carrot (Ramloch-Lorenz et al. (1993) The Plant J. 4:545-54); the promoter of the sulfate transporter geneSultrl; 3 (Yoshimoto et al. (2003) Plant Physiol. 131:1511-17); a promoter of a sucrose synthase gene (Nolte and Koch (1993) Plant Physiol. 101:899-905); and the promoter of a tobacco sucrose transporter gene (Kuhn et al. (1997) Science 275-1298-1300).

Possible promoters also include the Black Chemy promoter for Prunasin Hydrolase (PH DL1.4 PRO) (U.S. Pat. No. 6,797,859), Thioredoxin H promoter from cucumber and rice (Fukuda A et al. (2005). Plant Cell Physiol. 46(11): 1779-86), Rice (RSsl) (Shi, T. Wang et al. (1994). J. Exp. Bot. 45(274): 623-631) and maize sucrose synthese-1 promoters (Yang., N-S. et al. (1990) PNAS 87:4144-4148), PP2 promoter from pumpkin Guo, H. et al. (2004) Transgenic Research 13:559-566), At SUC2 promoter (Truernit, E. et al. (1995) Planta 196(3):564-70., At SAM-1 (S-adenosylmethionine synthetase) (Mijnsbrugge K V. et al. (1996) Planr. Cell. Physiol. 37(8): 1108-1115), and the Rice tungro bacilliform virus (RTBV) promoter (Bhattacharyya-Pakrasi et al. (1993) Plant J. 4(1):71-79).

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers include phenotypic markers such as β-galactosidase and fluorescent proteins such as green fluorescent protein (GFP) (Su et al. (2004) Biotechnol Bioeng 85:610-9 and Fetter et al. (2004) Plant Cell 16:215-28), cyan florescent protein (CYP) (Bolte et al. (2004) J. Cell Science 117:943-54 and Kato et al. (2002) Plant Physiol 129:913-42), and yellow florescent protein (PhiYFP™ from Evrogen, see, Bolte et al. (2004) J. Cell Science 117:943-54). For additional selectable markers, see generally, Yarranton (1992) Curr. Opin. Biotech. 3:506-511; Christopherson et al. (1992) Proc. Natl. Acad. Sci. USA 89:6314-6318; Yao et al. (1992) Cell 71:63-72; Reznikoff (1992) Mol. Microbiol. 6:2419-2422; Barkley et al. (1980) in The Operon, pp. 177-220; Hu et al. (1987) Cell 48:555-566; Brown et al. (1987) Cell 49:603-612; Figge et al. (1988) Cell 52:713-722; Deuschle et al. (1989) Proc. Natl. Acad. Sci. USA 86:5400-5404; Fuerst et al. (1989) Proc. Natl. Acad. Sci. USA 86:2549-2553; Deuschle et al. (1990) Science 248:480-483; Gossen (1993) Ph.D. Thesis, University of Heidelberg; Reines et al. (1993) *Proc. Natl. Acad. Sci. USA* 90:1917-1921; Labow et al. (1990) *Mol. Cell. Biol.* 10:3343-3356; Zambretti et al. (1992) *Proc. Natl. Acad. Sci. USA* 89:3952-3956; Baim et al. (1991) *Proc. Natl. Acad. Sci. USA* 88:5072-5076; Wyborski et al. (1991) *Nucleic Acids Res.* 19:4647-4653; Hillenand-Wissman (1989) *Topics Mol. Struc. Biol.* 10:143-162; Degenkolb et al. (1991) *Antimicrob. Agents Chemother.* 35:1591-1595; Kleinschnidt et al. (1988) *Biochemistry* 27:1094-1104; Bonin (1993) Ph.D. Thesis, University of Heidelberg; Gossen et al. (1992) *Proc. Natl. Acad. Sci. USA* 89:5547-5551; Oliva et al. (1992) *Antimicrob. Agents Chemother.* 36:913-919; Hlavka et al. (1985) *Handbook of Experimental Pharmacology*, Vol. 78 (Springer-Verlag, Berlin); Gill et al. (1988) *Nature* 334:721-724. Such disclosures are herein incorporated by reference. The above list of selectable marker genes is not meant to be limiting. Any selectable marker gene can be used in the present invention.

VI. Compositions Comprising Silencing Elements

One or more of the polynucleotides comprising the silencing element can be provided as an external composition such as a spray or powder to the plant, plant part, seed, a pest, or an area of cultivation. In another example, a plant is transformed with a DNA construct or expression cassette for expression of at least one silencing element. In either composition, the silencing element, when ingested by an insect, can reduce the level of a target pest sequence and thereby control the pest (i.e., a Coleopteran plant pest including a *Diabrotica* plant pest, such as, *D. virgifera virgifera, D. barberi, D. virgifera zeae, D. speciosa*, or *D. undecimpunctata howardi*). It is recognized that the composition can comprise a cell (such as plant cell or a bacterial cell), in which a polynucleotide encoding the silencing element is stably incorporated into the genome and operably linked to promoters active in the cell. Compositions comprising a mixture of cells, some cells expressing at least one silencing element are also encompassed. In other embodiments, compositions comprising the silencing elements are not contained in a cell. In such embodiments, the composition can be applied to an area inhabited by a pest. In one embodiment, the composition is applied externally to a plant (i.e., by spraying a field or area of cultivation) to protect the plant from the pest. Methods of applying nucleotides in such a manner are known to those of skill in the art.

The composition of the invention can further be formulated as bait. In this embodiment, the compositions comprise a food substance or an attractant which enhances the attractiveness of the composition to the pest.

The composition comprising the silencing element can be formulated in an agriculturally suitable and/or environmentally acceptable carrier. Such carriers can be any material that the animal, plant or environment to be treated can tolerate. Furthermore, the carrier must be such that the composition remains effective at controlling a pest. Examples of such carriers include water, saline, Ringer's solution, dextrose or other sugar solutions, Hank's solution, and other aqueous physiologically balanced salt solutions, phosphate buffer, bicarbonate buffer and Tris buffer. In addition, the composition may include compounds that increase the half-life of a composition. Various insecticidal formulations can also be found in, for example, US Publications 2008/0275115, 2008/0242174, 2008/0027143, 2005/0042245, and 2004/0127520, each of which is herein incorporated by reference.

It is recognized that the polynucleotides comprising sequences encoding the silencing element can be used to transform organisms to provide for host organism production of these components, and subsequent application of the host organism to the environment of the target pest(s). Such host organisms include baculoviruses, bacteria, and the like. In this manner, the combination of polynucleotides encoding the silencing element may be introduced via a suitable vector into a microbial host, and said host applied to the environment, or to plants or animals.

The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be stably incorporated into the genome of the cell (e.g., chromosome, plasmid, plastid, or mitochondrial DNA), converted into an autonomous replicon, or transiently expressed (e.g., transfected mRNA).

Microbial hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the sequences encoding the silencing element, and desirably, provide for improved protection of the components from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*, fungi, particularly yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinlandir*, and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces rosues, S. odorus, Kluyveromyces veronae*, and *Aureobasidium pollulans*. Of particular interest are the pigmented microorganisms.

A number of ways are available for introducing the polynucleotide comprising the silencing element into the microbial host under conditions that allow for stable maintenance and expression of such nucleotide encoding sequences. For example, expression cassettes can be constructed which include the nucleotide constructs of interest operably linked with the transcriptional and translational regulatory signals for expression of the nucleotide constructs, and a nucleotide sequence homologous with a sequence in the host organism, whereby integration will occur, and/or a replication system that is functional in the host, whereby integration or stable maintenance will occur.

Transcriptional and translational regulatory signals include, but are not limited to, promoters, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook et al. (2000); *Molecular Cloning: A Laboratory Manual* (3$^{rd}$ ed.; Cold Spring Harbor Laboratory Press, Plainview, N.Y.); Davis et al. (1980) *Advanced Bacterial*

*Genetics* (Cold Spring Harbor Laboratory, Cold Spring Harbor, N.Y.); and the references cited therein.

Suitable host cells include the prokaryotes and the lower eukaryotes, such as fungi. Illustrative prokaryotes, both Gram-negative and Gram-positive, include *Enterobacteriaceae*, such as *Escherichia, Erwinia, Shigella, Salmonella*, and *Proteus; Bacillaceae; Rhizobiceae*, such as *Rhizobium; Spirillaceae*, such as *photobacterium, Zymomonas, Serratia, Aeromonas, Vibrio, Desulfovibrio, Spirillum; Lactobacillaceae; Pseudomonadaceae*, such as *Pseudomonas* and *Acetobacter; Azotobacteraceae* and *Nitrobacteraceae*. Among eukaryotes are fungi, such as *Phycomycetes* and *Ascomycetes*, which includes yeast, such as *Saccharomyces* and *Schizosaccharomyces*; and *Basidiomycetes* yeast, such as *Rhodotorula, Aureobasidium, Sporobolomyces*, and the like.

Characteristics of particular interest in selecting a host cell for purposes of the invention include ease of introducing the coding sequence into the host, availability of expression systems, efficiency of expression, stability in the host, and the presence of auxiliary genetic capabilities. Characteristics of interest for use as a pesticide microcapsule include protective qualities, such as thick cell walls, pigmentation, and intracellular packaging or formation of inclusion bodies; leaf affinity; lack of mammalian toxicity; attractiveness to pests for ingestion; and the like. Other considerations include ease of formulation and handling, economics, storage stability, and the like.

Host organisms of particular interest include yeast, such as *Rhodotorula* spp., *Aureobasidium* spp., *Saccharomyces* spp., and *Sporobolomyces* spp., phylloplane organisms such as *Pseudomonas* spp., *Erwinia* spp., and *Flavobacterium* spp., and other such organisms, including *Pseudomonas aeruginosa, Pseudomonas fluorescens, Saccharomyces cerevisiae, Bacillus thuringiensis, Escherichia coli, Bacillus subtilis*, and the like.

The sequences encoding the silencing elements encompassed by the invention can be introduced into microorganisms that multiply on plants (epiphytes) to deliver these components to potential target pests. Epiphytes, for example, can be gram-positive or gram-negative bacteria.

The silencing element can be fermented in a bacterial host and the resulting bacteria processed and used as a microbial spray in the same manner that *Bacillus thuringiensis* strains have been used as insecticidal sprays. Any suitable microorganism can be used for this purpose.

By way of example, *Pseudomonas* has been used to express *Bacillus thuringiensis* endotoxins as encapsulated proteins and the resulting cells processed and sprayed as an insecticide Gaertner et al. (1993), in *Advanced Engineered Pesticides*, ed. L. Kim (Marcel Decker, Inc.).

Alternatively, the components of the invention are produced by introducing heterologous genes into a cellular host. Expression of the heterologous sequences results, directly or indirectly, in the intracellular production of the silencing element. These compositions may then be formulated in accordance with conventional techniques for application to the environment hosting a target pest, e.g., soil, water, and foliage of plants. See, for example, EPA 0192319, and the references cited therein.

In the present invention, a transformed microorganism can be formulated with an acceptable carrier into separate or combined compositions that are, for example, a suspension, a solution, an emulsion, a dusting powder, a dispersible granule, a wettable powder, and an emulsifiable concentrate, an aerosol, an impregnated granule, an adjuvant, a coatable paste, and also encapsulations in, for example, polymer substances.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaracides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the present invention (i.e., at least one silencing element) are normally applied in the form of compositions and can be applied to the crop area, plant, or seed to be treated. For example, the compositions may be applied to grain in preparation for or during storage in a grain bin or silo, etc. The compositions may be applied simultaneously or in succession with other compounds. Methods of applying an active ingredient or a composition that contains at least one silencing element include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; carboxylate of a long chain fatty acid; an N-acylsarcosinate; mono- or di-esters of phosphoric acid with fatty alcohol ethoxylates or salts of such esters; fatty alcohol sulfates such as sodium dodecyl sulfate, sodium octadecyl sulfate, or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphtalene sulfonates, e.g., butyl-naphthalene sulfonate; salts of sulfonated naphthalene-formaldehyde condensates; salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate or dioctyl succinate. Non-ionic agents include condensation products of fatty acid esters, fatty alcohols, fatty acid amides or fatty- alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitan fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include, but are not limited to, inorganic minerals such as kaolin, phyllosilicates, carbonates, sulfates, phosphates, or botanical materials such as cork, powdered corncobs, peanut hulls, rice hulls, and walnut shells.

The compositions comprising the silencing element can be in a suitable form for direct application or as a concentrate of primary composition that requires dilution with a suitable quantity of water or other diluent before application.

The compositions (including the transformed microorganisms) can be applied to the environment of an insect pest (such as a Coleoptera plant pest or a *Diabrotica* plant pest) by, for example, spraying, atomizing, dusting, scattering, coating or pouring, introducing into or on the soil, introducing into irrigation water, by seed treatment or general application or dusting at the time when the pest has begun to appear or before the appearance of pests as a protective measure. For example, the composition(s) and/or transformed microorganism(s) may be mixed with grain to protect the grain during storage. It is generally important to obtain good control of pests in the early stages of plant growth, as this is the time when the plant can be most severely damaged. The compositions can conveniently contain another insecticide if this is thought necessary. In an embodiment of the invention, the composition(s) is applied directly to the soil, at a time of planting, in granular form of a composition of a carrier and dead cells of a *Bacillus* strain or transformed microorganism of the invention. Another embodiment is a granular form of a composition comprising an agrochemical such as, for example, a herbicide, an insecticide, a fertilizer, in an inert carrier, and dead cells of a *Bacillus* strain or transformed microorganism of the invention.

VII. Plants, Plant Parts, and Methods of Introducing Sequences into Plants

In one embodiment, the methods of the invention involve introducing a polynucleotide into a plant. "Introducing" is intended to mean presenting to the plant the polynucleotide in such a manner that the sequence gains access to the interior of a cell of the plant. The methods of the invention do not depend on a particular method for introducing a sequence into a plant, only that the polynucleotide or polypeptides gains access to the interior of at least one cell of the plant. Methods for introducing polynucleotides into plants are known in the art including, but not limited to, stable transformation methods, transient transformation methods, and virus-mediated methods.

"Stable transformation" is intended to mean that the nucleotide construct introduced into a plant integrates into the genome of the plant and is capable of being inherited by the progeny thereof "Transient transformation" is intended to mean that a polynucleotide is introduced into the plant and does not integrate into the genome of the plant or a polypeptide is introduced into a plant.

Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. Nos. 5,563,055 5,981,840), direct gene transfer (Paszkowski et al. (1984) *EMBO J.* 3:2717-2722), and ballistic particle acceleration (see, for example, U.S. Pat. Nos. 4,945,050; 5,879,918; 5,886,244; and, 5,932,782; Tomes et al. (1995) in *Plant Cell, Tissue, and Organ Culture: Fundamental Methods*, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) Plant Physiol. 91:440-444 (maize); Fromm et al. (1990) *Biotechnology* 8:833-839 (maize); Hooykaas-Van Slogteren et al. (1984) *Nature (London)* 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

In specific embodiments, the silencing element sequences of the invention can be provided to a plant using a variety of transient transformation methods. Such transient transformation methods include, but are not limited to, the introduction of the protein or variants and fragments thereof directly into the plant or the introduction of the transcript into the plant. Such methods include, for example, microinjection or particle bombardment. See, for example, Crossway et al. (1986) Mol. Gen. Genet. 202:179-185; Nomura et al. (1986) Plant Sci. 44:53-58; Hepler et al. (1994) Proc. Natl. Acad. Sci. 91: 2176-2180 and Hush et al. (1994) The Journal of Cell Science 107:775-784, all of which are herein incorporated by reference. Alternatively, polynucleotides can be transiently transformed into the plant using techniques known in the art. Such techniques include viral vector systems and the precipitation of the polynucleotide in a manner that precludes subsequent release of the DNA. Thus, the transcription from the particle-bound DNA can occur, but the frequency with which it is released to become integrated into the genome is greatly reduced. Such methods include the use of particles coated with polyethylimine (PEI; Sigma #P3143).

In other embodiments, the polynucleotide of the invention may be introduced into plants by contacting plants with a virus or viral nucleic acids. Generally, such methods involve incorporating a nucleotide construct of the invention within a viral DNA or RNA molecule. Further, it is recognized that promoters of the invention also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931, and Porta et al. (1996) *Molecular Biotechnology* 5:209-221; herein incorporated by reference.

Methods are known in the art for the targeted insertion of a polynucleotide at a specific location in the plant genome. In one embodiment, the insertion of the polynucleotide at a desired genomic location is achieved using a site-specific recombination system. See, for example, WO99/25821, WO99/25854, WO99/25840, WO99/25855, and WO99/25853, all of which are herein incorporated by reference. Briefly, the polynucleotide of the invention can be contained in transfer cassette flanked by two non-recombinogenic recombination sites. The transfer cassette is introduced into a plant having stably incorporated into its genome a target site which is flanked by two non-recombinogenic recombination sites that correspond to the sites of the transfer cassette. An appropriate recombinase is provided and the transfer cassette is integrated at the target site. The polynucleotide of interest is thereby integrated at a specific chromosomal position in the plant genome.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting progeny having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a polynucleotide of the invention, for example, an expression cassette of the invention, stably incorporated into their genome.

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

The present invention may be used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). In specific embodiments, plants of the present invention are crop plants (for example, corn, alfalfa, sunflower, *Brassica*, soybean, cotton, safflower, peanut, sorghum, wheat, millet, tobacco, etc.). In other embodiments, corn and soybean plants and sugarcane plants are optimal, and in yet other embodiments corn plants are optimal.

Other plants of interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include beans and peas. Beans include guar, locust bean, fenugreek, soybean, garden beans, cowpea, mungbean, lima bean, fava bean, lentils, chickpea, etc.

VIII. Methods of Use

Methods of the invention comprise methods for controlling a pest (i.e., a Coleopteran plant pest, including a *Diabrotica* plant pest, such as, *D. virgifera virgifera, D. barberi, D. virgifera zeae, D. speciosa*, or *D. undecimpunctata howardi*). The method comprises feeding or applying to a pest a composition comprising a silencing element of the invention, wherein said silencing element, when ingested or contacted by a pest (i.e., a Coleopteran plant pest including a *Diabrotica* plant pest, such as, *D. virgifera virgifera, D. barberi, D. virgifera zeae, D. speciosa*, or *D. undecimpunctata howardi*), reduces the level of a target polynucleotide of the pest and thereby controls the pest. The pest can be fed the silencing element in a variety of ways. For example, in one embodiment, the polynucleotide comprising the silencing element is introduced into a plant. As the Coleopteran plant pest or *Diabrotica* plant pest feeds on the plant or part thereof expressing these sequences, the silencing element is delivered to the pest. When the silencing element is delivered to the plant in this manner, it is recognized that the silencing element can be expressed constitutively or alternatively, it may be produced in a stage-specific manner by employing the various inducible or tissue-preferred or developmentally regulated promoters that are discussed elsewhere herein. In specific embodiments, the silencing element is expressed in the roots, stalk or stem, leaf including pedicel, xylem and phloem, fruit or reproductive tissue, silk, flowers and all parts therein or any combination thereof.

In another method, a composition comprising at least one silencing element of the invention is applied to a plant. In such embodiments, the silencing element can be formulated in an agronomically suitable and/or environmentally acceptable carrier, which is preferably, suitable for dispersal in fields. In addition, the carrier can also include compounds that increase the half life of the composition. In specific embodiments, the composition comprising the silencing element is formulated in such a manner such that it persists in the environment for a length of time sufficient to allow it to be delivered to a pest. In such embodiments, the composition can be applied to an area inhabited by a pest. In one embodiment, the composition is applied externally to a plant (i.e., by spraying a field) to protect the plant from pests.

In certain embodiments, the constructs of the present invention can be stacked with any combination of polynucleotide sequences of interest in order to create plants with a desired trait. A trait, as used herein, refers to the phenotype derived from a particular sequence or groups of sequences. For example, the polynucleotides of the present invention may be stacked with any other polynucleotides encoding polypeptides having pesticidal and/or insecticidal activity, such as other *Bacillus thuringiensis* toxic proteins (described in U.S. Pat. Nos. 5,366,892; 5,747,450; 5,737,514; 5,723,756; 5,593,881; and Geiser et al. (1986) Gene 48:109), lectins (Van Damme et al. (1994) *Plant Mol. Biol.* 24:825, pentin (described in U.S. Pat. No. 5,981,722), and the like. The combinations generated can also include multiple copies of any one of the polynucleotides of interest. The polynucleotides of the present invention can also be stacked with any other gene or combination of genes to produce plants with a variety of desired trait combinations including, but not limited to, traits desirable for animal feed such as high oil genes (e.g., U.S. Pat. No. 6,232,529); balanced amino acids (e.g., hordothionins (U.S. Pat. Nos. 5,990,389; 5,885,801; 5,885,802; and 5,703,409); barley high lysine (Williamson et al. (1987) *Eur. J. Biochem.* 165:99-106; and WO 98/20122) and high methionine proteins (Pedersen et al. (1986) *J. Biol. Chem.* 261:6279; Kirihara et al. (1988) *Gene* 71:359; and Musumura et al. (1989) *Plant Mol. Biol.* 12:123)); increased digestibility (e.g., modified storage proteins (U.S. application Ser. No. 10/053,410, filed Nov. 7, 2001); and thioredoxins (U.S. application Ser. No. 10/005,429, filed Dec. 3, 2001)); the disclosures of which are herein incorporated by reference.

The polynucleotides of the present invention can also be stacked with traits desirable for disease or herbicide resistance (e.g., fumonisin detoxification genes (U.S. Pat. No. 5,792,931); avirulence and disease resistance genes (Jones et al. (1994) *Science* 266:789; Martin et al. (1993) *Science* 262:1432; Mindrinos et al. (1994) Cell 78:1089); acetolactate synthase (ALS) mutants that lead to herbicide resistance such as the S4 and/or Hra mutations; inhibitors of glutamine synthase such as phosphinothricin or basta (e.g., bar gene); and glyphosate resistance (EPSPS gene)); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) *J. Bacteriol.* 170:5837-5847) facilitate expression of polyhydroxyalkanoates (PHAs)); the disclosures of which are herein incorporated by reference. One could also combine the polynucleotides of the present invention with polynucleotides providing agronomic traits such as male sterility (e.g., see U.S. Pat. No. 5,583,210), stalk strength, drought resistance (e.g., U.S. Pat. No. 7,786,353), flowering time, or transformation technology traits such as cell cycle regulation or gene targeting (e.g., WO 99/61619, WO 00/17364, and WO 99/25821); the disclosures of which are herein incorporated by reference.

These stacked combinations can be created by any method including, but not limited to, cross-breeding plants by any conventional or TopCross methodology, or genetic transformation. If the sequences are stacked by genetically transforming the plants (i.e., molecular stacks), the polynucleotide sequences of interest can be combined at any time and in any order. For example, a transgenic plant comprising one or more desired traits can be used as the target to introduce further traits by subsequent transformation. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO99/25821, WO99/25854, WO99/25840, WO99/25855, and WO99/25853, all of which are herein incorporated by reference.

The following examples are offered by way of illustration and not by way of limitation.

EXPERIMENTAL

Example 1

In Vitro Transcript dsRNA Screening Method

A cDNA library was produced from neonate western corn rootworm larvae by standard methods. A selected cDNA clone containing an expressed sequence tag was amplified in a PCR using universal primers to the plasmid backbone and flanking the EST insert. The universal primers also contained T7 RNA polymerase sites. Product of the PCR reaction was used as the template for an in vitro transcription (IVT) reaction to produce long double stranded RNAs. Following enzymatic digestion and removal of the DNA template and single stranded RNA, the IVT reaction products were incorporated into artificial insect diet as described below.

Different target selection strategies were used in this invention to identify RNAi active targets with insecticidal activities in corn rootworn diet based assay. cDNA libraries were produced from neonate or midgut of 3rd instar western corn rootworm larvae by standard methods. Randomly selected cDNA clones containing an expressed sequence tag (EST) were amplified in a PCR using target specific primers (forward and reverse Table 1), and provided in the sequence listing included herein, to generate DNA templates. The target specific primers also contain T7 RNA polymerase sites (T7 sequence at 5' end of each primer). Second set of cDNA clones was selected based on homology to known lethal genes from other insects, primarily *Drosophila melanogaster*. A third set of genes was tested based on involvement in proteosome functions. Identification of these genes was based on a progressive homology search beginning with a list of proteosome genes identified in humans cross referenced to the *Tribolium* genome database. Hits from *Tribolium* were then used to parse western corn rootworm sequence database. Proteosome genes were categorized as 26S subunit non ATPase, 26S subunit ATPase, alpha type, and beta type genes.

Region(s) of WCRW genes were produced by PCR followed by in vitro transcription (IVT) to produce long double stranded RNAs. The IVT reaction products are quantified in gel and incorporated into artificial insect diet for first-round IVT screening (FIS) as described below.

Insect Bioassays dsRNAs were incorporated into standard WCRW artificial diet at a final concentration of 50 ppm in a 96 well microtiter plate format. 5 μl of the IVT reaction (300 ng/ul) were added to a given well of a 96 well microtiter plate. 25 μl of molten lowmelt Western corn rootworm diet were added to the sample and shaken on an orbital shaker to mix the sample and diet. Once the diet has solidified, eight wells were used for each RNA sample. Preconditioned $1^{st}$ instar WCRW (neonate insects were placed on neutral diet for 24 hours prior to transfer to test material) were added to the 96 well microtiter plates at a rate of 3-5 insects/well. Plates were sealed with mylar which was then punctured twice above each well of the microtiter plate using a superfine insect collection pin. To prevent drying of the diet, plates were first placed inside a plastic bag with a slightly damp cloth and the bags were placed inside an incubator set at 28 C and 70 RH. The assay was scored for mortality and stunting affects after 7 days and an average was determined based on assignment of numeric values to each category of impact (3=mortality, 2=severe stunting, 1=stunting, 0=no affect). The number reported in this and all diet assay tables reflect the average score across all observations. A score of 3 represents complete mortality across all observations. A score of 2.5 would indicate half the wells demonstrating mortality and half scored as severe stunting. The assay results can be found in Table 1A.

DNA sequences which encode double stranded RNAs which were shown to have insecticidal activity (average score above 1.5) against corn rootworms using the assay described in Example 1 are listed in Table 1. To identify full length of cDNA or full open-reading frame of RNAi active target gene, full insert sequencing for EST clones and transcriptome analyses of midgut RNA samples were conducted. Sequences of all target transcripts containing full length cDNA or longer transcripts were also listed in Table 1. Some of these sequences were used for RNAi active fragment search.

Example 2

Sequences Having Insecticidal Activity

DNA sequences which encode double stranded RNAs which were shown to have insecticidal activity against corn rootworms using the assay described in Example 1 are set forth below. Non-limiting examples of target polynucleotides are set forth below in Table 1A and B, and SEQ ID NOS: 1, 4, 5, 8, 9, 12, 13, 16, 17, 20, 21, 24, 25, 28, 29, 32, 33, 36, 37, 40, 41, 44, 45, 48, 49, 52, 53, 54, 55, 56, 57, 60, 61, 64, 65, 68, 69, 72, 73, 76, 77, 80, 81, 84, 85, 88, 89, 92, 93, 96, 97, 100, 101, 104, 105, 108, 109, 112, 113, 116, 117, 120, 121, 124, 125, 128, 129, 132, 133, 136, 137, 140, 141, 144, 145, 148, 149, 152, 153, 156, 157, 160, 161, 164, 165, 168, 169, 172, 173, 176, 177, 180, 181, 184, 185, 188, 189, 192, 193, 196, 197, 200, 201, 204, 205, 208, 209, 212, 213, 216, 217, 220, 221, 224, 225, 228, 229, 232, 233, 236, 237, 240, 241, 244, 245, 248, 249, 252, 253, 256, 257, 260, 261, 264, 265, 268, 269, 272, 273, 276, 277, 280, 281, 284, 285, 288, 289, 292, 293, 296, 297, 300, 301, 304, 305, 308, 309, 312, 313, 316, 317, 320, 321, 324, 325, 328, 329, 332, 333, 336, 337, 340, 341, 344, 345, 348, 349, 352, 353, 356, 357, 360, 361, 364, 365, 368, 369, 372, 373, 376, 377, 380, 381, 384, 385, 388, 389, 392, 393, 396, 397, 400, 401, 404, 405, 408, 409, 412, 413, 416, 417, 420, 421, 424, 425, 428, 429, 432, 433, 436, 437, 440, 441, 444, 445, 448, 449, 452, 453, 456, 457, 460, 461, 464, 465, 468, 469, 472, 473, 476, 477, 480, 481, 484, 485, 488, 489, 492, 493, 496, 497, 500, 501, 504, 505, 508, 509, 512, 513, 516, 517, 520, 521, 524, 525, 528, 529, 532, 533, 536, 537, 540, 541, 544, 545, 548, 549, 552, 553, 556, 557, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 700, 701, 702, 703, 706, 707, 708, 709, 712, 713, 714, 715, 718, 719, 720, 721, or active variants and fragments thereof, and complements thereof, including, for example, SEQ ID NOS: 1, 9, 37, 45, 49, 61, 65, 77, 101, 113, 137, 141, 145, 149, 153, 157, 169, 173, 181, 185, 189, 205, 217, 225, 233, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, and active variants and fragments thereof, and complements thereof, and SEQ ID NOS: 4, 140, 144, 148, 693, 694, 695, 696, 697, 700, 701, 702, 703, 706, 707, 708, 709, 712, 713, 714, 715, 718, 719, 720, 721 and active variants and fragments thereof, and complements thereof.

Subregions of efficacious dsRNAs were designed to improve insecticidal activities in diet and dsRNA expression in planta. These fragments were assayed in the same manner as the original FIS assays described above. Regions demonstrating a severe impact on larval phenotype (mortality or severe growth retardation) were advanced to informal inhibitory concentration (IC50) assays. IC50 assays used doses starting at 50 ppm and progressing downward by ½ step dilutions through 25, 12.5, 6, 3, 1.5, and 0.75 pppm. 12 observations were included for each rate. Assay methods were the same as described above for primary screens. Calculations of inhibition relied on scoring for both mortality and severe stunting Selected fragments were advanced to formal dose response assays where both LC50 and IC50 values were calculated and described in Table 2 (Seq No. 561 to 692). These assays included an initial range finding assay followed by dose response assays for selected ranges including 3 replications of the experiment. Fragments with confirmed IC50 values below 2 ppm were advanced to plant transformation vector construction.

The proteosome alpha subunit type 3 (PAT3) target gene was used as a model for gene and construct optimization. As a first step, the gene was divided into ⅓, ⅙, and 1/12 size fragments (f). In addition, f11-13 represent spanning segments over the boundaries of the first four ⅙th fragments. FIG. 5 provides a diagram of the fragments of PAT3.

Plant preferred fragments were identified from active RNAi gene targets and tested in dsRNA artificial diet assays. Selection of these plant preferred regions was based on avoiding destabilizing elements and motifs, or regions with unsuitable base composition. Homology assessments were also employed to avoid potential non target organisms. Finally, fragments with a size range of 150-250 bp were preferred. All rules were considered in selecting fragments but fragments were not excluded from consideration based on any one rule. The table 2 includes data for initial FIS samples and subsequent fragments insecticidal assay. Selected samples were advanced to IC50 and LC50 determinations.

Example 3

Identify RNAi Active Targets from Other Insects

To identify RNAi active genes from other important corn pests or no-target insects, transcriptome experiments were completed using 3$^{rd}$ instar larvae from Northern corn rootworm (*Diabrotica barberi*), Southern corn rootworm (*Diabrotica undecimpunctata*), Mexican Bean Beetle (*Epilachna varivestis*), Colorado potato beetle (*Leptinotarsa decemlineata*), Insidious flower bug (*Orius insidiosus*) and Spotted Lady Beetle (*Coleomegilla maculata*, [CMAC]). Homologous transcripts of RNAi active leads were listed in Table 3 (Seq No. 693 to 723). This sequence data is important for designing fragments to suppress target pest genes and avoid knockdown same gene in no target insects.

Example 4

Insecticidal RNA Targets in WCRW Midgut

Two RNAi active targets Ryanr and HP2 (Table 1 and Table 2) were identified through random cDNA FIS screening. Ryanr was identified in a previous FIS screening (US 2011/0054007A1). Fragments of these targets showed very strong insecticidal activities. Homologous searches reveal that Ryanr and HP2 showed 54% and 49% identity to *Drosophila* Ssk and Mesh, respectively. The Mesh-Ssk protein complex is required for septate junction formation in the *Drosophila* midgut. See the amino acid sequence alignment of WCRW Ryanr and *Drosophila* Ssk in FIG. 4.

Example 5

Transformation of Maize

Immature maize embryos from greenhouse donor plants are bombarded with a plasmid containing the silencing element of the invention operably linked to either a tissue specific, tissue selective, or constitutive promoter and the selectable marker gene PAT (Wohlleben et al. (1988) *Gene* 70:25-37), which confers resistance to the herbicide Bialaphos. In one embodiment, the constructs will express a long double stranded RNA of the target sequence set forth in table 1. Such a construct can be linked to the dMMB promoter. Alternatively, the selectable marker gene is provided on a separate plasmid. Transformation is performed as follows. Media recipes follow below.

Preparation of Target Tissue

The ears are husked and surface sterilized in 30% Clorox bleach plus 0.5% Micro detergent for 20 minutes, and rinsed two times with sterile water. The immature embryos are excised and placed embryo axis side down (scutellum side up), 25 embryos per plate, on 560Y medium for 4 hours and then aligned within the 2.5 cm target zone in preparation for bombardment.

A plasmid vector comprising the silencing element of interest operably linked to either the tissue specific, tissue selective, or constitutive promoter is made. This plasmid DNA plus plasmid DNA containing a PAT selectable marker is precipitated onto 1.1 µm (average diameter) tungsten pellets using a $CaCl_2$ precipitation procedure as follows: 100 µl prepared tungsten particles in water; 10 µl (1 µg) DNA in Tris EDTA buffer (1 µg total DNA); 100 µl 2.5 M $CaCl_2$; and, 10 µl 0.1 M spermidine.

Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol, and centrifuged for 30 seconds. Again the liquid is removed, and 105 µl 100% ethanol is added to the final tungsten particle pellet. For particle gun bombardment, the tungsten/DNA particles are briefly sonicated and 10 µl spotted onto the center of each macrocarrier and allowed to dry about 2 minutes before bombardment.

The sample plates are bombarded at level #4 in a particle gun. All samples receive a single shot at 650 PSI, with a total of ten aliquots taken from each tube of prepared particles/DNA.

Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity.

Plants are monitored and scored for the appropriate marker, such as the control of a Coleoptera plant pest, such as a *Diabrotica* plant pest and have insecticidal activity. For example, $R_0$ plant roots are fed to western corn rootworm larvae (WCR, *Diabrotica virgifera*), Transgenic corn roots are handed-off in Petri dishes with MSOD medium containing antibiotics and glyphosate for in vitro selection. Two WCR larvae are infested per root in each dish with a fine tip paintbrush. The dishes are scaled with Parafilm to prevent the larvae from escaping. The assays are placed into a 27° C., 60% RH Percival incubator incomplete darkness. Contamination and larval quality are monitored. After six days of feeding on root tissue, the larvae are transferred to WCR diet in a 96 well plate. The larvae are allowed to feed on the diet for eight days making the full assay fourteen days long. Larval mass and survivorship are recorded for analysis. A one-way ANOVA analysis and a Dunnett's test is performed on the larval mass data to look for statistical significance compared to an untransformed negative control. WCR larvae stunting is measured after feeding on two events and compared to growth of larvae fed on negative control plants.

In other assays, transgenic corn plants ($R_0$) generated are planted into 10-inch pots containing Metromix soil after reaching an appropriate size. When plants reach the V4 growth stage, approximately 1000 Western corn rootworm (WCR, *Diabrotica virgifera*) eggs are infested into the root zone. Non-transgenic corn of the same genotype is infested at a similar growth stage to serve as a negative control. Eggs are pre-incubated so hatch occurs within 24 hours of infestation. Larvae are allowed to feed on the root systems for 3 weeks. Plants are removed from the soil and washed so that the roots can be evaluated for larval feeding. Root damage is rated using a Node Injury Scale (NIS) to score the level of damage where a 0 indicates no damage, a 1 indicates that one node of roots is pruned to within 1.5 inches, a 2 indicates that 2 nodes are pruned, while a 3 indicates that 3 nodes are pruned. Because the plants being used for evaluation are directly out of tissue culture after transformation and because transformation events are unique, only a single plant is evaluated per event at this time. The plants in the assay that present signs or symptoms of larval feeding indicate that a successful infestation is obtained. Negative control plant roots are moderately to severely damaged averaging whereas roots of the transgenic plants provide substantial control of larval feeding, with about 0.2 or less on the Node Injury Scale.

Bombardment medium (560Y) comprises 4.0 g/l N6 basal salts (SIGMA C-1416), 1.0 ml/l Eriksson's Vitamin Mix (1000× SIGMA-1511), 0.5 mg/l thiamine HCl, 120.0 g/l sucrose, 1.0 mg/l 2,4-D, and 2.88 g/l L-proline (brought to volume with D-I $H_2O$ following adjustment to pH 5.8 with KOH); 2.0 g/l Gelrite (added after bringing to volume with D-I $H_2O$); and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, and 2.0 mg/l 2,4-D (brought to volume with D-I $H_2O$ following adjustment to pH 5.8 with KOH); 3.0 g/l Gelrite (added after bringing to volume with D-I $H_2O$); and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCl, 0.10 g/l pyridoxine HCl, and 0.40 g/l glycine brought to volume with polished D-I $H_2O$) (Murashige and Skoog (1962) *Physiol. Plant.* 15:473), 100 mg/l myo-inositol, 0.5 mg/l zeatin, 60 g/l sucrose, and 1.0 ml/l of 0.1 mM abscisic acid (brought to volume with polished D-I $H_2O$ after adjusting to pH 5.6); 3.0 g/l Gelrite (added after bringing to volume with D-I $H_2O$); and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCl, 0.10 g/l pyridoxine HCl, and 0.40 g/l glycine brought to volume with polished D-I $H_2O$), 0.1 g/l myo-inositol, and 40.0 g/l sucrose (brought to volume with polished D-I $H_2O$ after adjusting pH to 5.6); and 6 g/l bacto-agar (added after bringing to volume with polished D-I $H_2O$), sterilized and cooled to 60° C.

Example 6

*Agrobacterium*-mediated Transformation of Maize

For *Agrobacterium*-mediated transformation of maize with a silencing element of the invention, the method of Zhao is employed (U.S. Pat. No. 5,981,840, and PCT patent publication WO98/32326; the contents of which are hereby incorporated by reference). Such a construct can, for example, express a long double stranded RNA of the target sequence set forth in table 1. Such a construct can be linked to the dMMB promoter. Briefly, immature embryos are isolated from maize and the embryos contacted with a suspension of *Agrobacterium*, where the bacteria are capable of transferring the polynucleotide comprising the silencing element to at least one cell of at least one of the immature embryos (step 1: the infection step). In this step the immature embryos are immersed in an *Agrobacterium* suspension for the initiation of inoculation. The embryos are co-cultured for a time with the *Agrobacterium* (step 2: the co-cultivation step). The immature embryos are cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). The immature embryos are cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). The immature embryos are cultured on solid medium with a selective agent resulting in the selective growth of transformed cells. The callus is then regenerated into plants (step 5: the regeneration step), and calli grown on selective medium are cultured on solid medium to regenerate the plants. Assays for insecticidal activity can be performed as described above in Example, 5.

Example 7

Expression of Silencing Elements in Maize

The silencing elements are expressed in a maize plant as hairpins and the plant is tested for insecticidal activity against corn root worms.

Maize plants are transformed with Plasmids containing at least one polynucleotide disclosed herein and plants expressing the silencing elements are transplanted from 272V plates into greenhouse flats containing Fafard Superfine potting mix. Approximately 10 to 14 days after transplant, plants (now at growth stage V2-V3) are transplanted into treepots containing Fafard Superfine potting mix. At 14 days post greenhouse send date, plants are infested with 100 eggs of western corn root worms (WCRW)/plant. For later sets, a second infestation of 100 eggs WCRW/plant is done 14 days after the first infestation and scoring is at 14 days after the second infestation. 21 days post infestation, plants are scored using CRWNIS. Those plants with a score of ≤0.5 are transplanted into large pots containing SB300 for seed.

The sequences referred to herein, SEQ. ID NOs: 1-723 are filed concurrently herewith in a textfile and are incorporated herein in their entirities.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this invention belongs unless clearly indicated otherwise.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, certain changes and modifications may be practiced within the scope of the appended claims.

SEQUENCE LISTING (723 sequences)

SEQ ID NO: 1 - DNA, 593 bp, Diabrotica virgifera
  misc_feature (1)..(593): RNAi target sequence
  misc_feature (480)..(480): n can be any nucleotide
  misc_feature (495)..(495): n can be any nucleotide
tgacttcacacttccagatggttctagagcagcaatagtgaataacataaatgacatggaaagggtttacaatgattttggttccaaatggatgttggaggatgtgttagatcctcaaaagggtagagcattgttccacagggaattcggaaggacttcagcgacttacaacaacaaaacgttcaagcctcaattcctaatgaatccggaagatttcctaccaaccaacagatctacagatcttaagcgaatatccgaaatatgtcctctaaagttgtacgaatgttactacgattacgctatgacggttgacagggatttggcgcattacaccaagaattataaagccacgatctatcaatataaagaaacgacaaggaggaaagttgtgtcttgcggagtactagaaacaccgagattcggacgaaagagtactttcctgttcgtgcccggtacgaaggttacctatgaatgcatccnagagttcgtgttggntaggtgatcagcggagagagtgtcaagcggatggaacatggaatattcctgaatacggatacacatattgcttacgtcagcaggaatactctcaacga

SEQ ID NO: 2 - DNA, 22 bp, Artificial Sequence
  primer
  misc_feature (1)..(22): forward primer
tgacttcacacttccagatggt

SEQ ID NO: 3 - DNA, 22 bp, Artificial Sequence
  primer
  misc_feature (1)..(22): reverse primer
tcgttgagagtattcctgctga

SEQ ID NO: 4 - DNA, 5689 bp, Diabrotica virgifera
  misc_feature (1)..(5689): WCRW transcript ta0120.010_diavv
tgttcatcaccaacgctgaccaacgtgagagtagcaactttttttgatgtgatgtgcgccagtttgtagtgccaaataaccaaaatgtggttcaagtactttgttatttttgttttgtttagtgttagcgttaaaggactagatggtgatcttccaccagatgtcgaaactatcgatgtggagactacgaatgtaagtaacgcggatccagacgcagggaaacctattccggtggaagatacgcctaatggagtccctccagtgaatacaaactatgaagtagataaatccttagttaatgtaaccaatagtttggtaaatgtgactaaaaatcccagacggacttatcagacagttaataaaatgggcaaatattcgacattttatgctgcagattacgatcctatgacctcagacacagctccaccagacactgaccaacgaggaggaggaggaactccatacactatatcagaaccgagactggcagaaataaggaaacattttatgtacccatttttcgataaaggaggcagtgataataacttgggagatttccaaaaggacattcaatcttccattcctcaggtgcacaagaatttaaacttccagttgcctttctttggattcaggtataattacacaagagtttcagtgaatgggtatctggaattcagcgatccacctccaaattatgactatccattagtatttccaattaaagaatggcccaaaaagaatgatcctgcctttattggcattttcttcagcagatgcagaatcggtaatctacgtgatggagacattgatcaaagaacacccggggtctattttagaatggaaagagatttaagaacgaggcaagacagaatgggtgtagaaattagagaaagacttaagtgggatatcagaacaggagtcattggatcagaaacattcgatcctaagcacgccgttattgtcacttggaaaaatgttactttcactggaggattcgctaatgctaaatacaagacaaacaccttccaaatggttcttgcaactgacgaagtcttcacttacgcgatgttcaactacctcaacttggactggacctcccacactgaagcgggtggtgattcccaaaacggggaaggtggtgtcagtgcctatgttggttttaacgctggaaacggtaccagaagctacgaatacaatccttacagtcaagcttccgtcattcgagatctcacatcagttggatttggaaatggttttaagggaagacatattttccgtatagacgaagacattttgcttggatcgtgcaacaaagatatagatggtgccaaccttcccctgaaattcgctcctgaaagtggtaacatgttgggtggaacagtggtaaatataactggtccatgcttcaatttgaatgataggattcgatgcaagtttgacgtatcaaatgaagtatttgggtatgttgttgataaaaacagagctatctgtgtacaacctcaactttatgccgaaggatgggtgaatcttcaaattgctgttaattccgaagcattcaagtggaaggggaagtattatgtagaatcacctgctagtgcgactcaaaaaatcttctttaaggacatgaaattacacgaaaaatctccgagcgaattaaaaatcacttgggagaagcagaatttgaccacaaacgacaacgctaacatccgaatttctctctggggttacagagaaacgactatgaaaccagtgtttgtttatatcaccgatatcgctgataatgttcaaaacattggagaacacacgattgttccttctcagtttagaactagagtcaatcaatatctgactgatattaagtttggattcctccaaattaatttaactgagtctatcacagttaatacatatactacaagccagagcagcatagaattaacaccggtaatatggagccgacccattccactcggttggtacttccagttccaatgggaaaaccagtacggtaaaaattggcccaaatatctatgtgacgattggctgagaacggacagatatctaaaaaacttcgcccacgaacttgctcaatgtccctgcaccgtcgaacaggctttagctgacaagggcaggtttatgccagacttcgattgcgacaaagattcgaacccgatttgttactataacaaccaagcacttcattgtgtgaaaactggatctcccactttagaaggctccgaacaacaatgttgctatgataaaaacggctttttgatgctctcttacgatcagcaatggggttctagtccgagacgttgccacaacttgggtaaaatgccttacaatgaagcgacaaaagtgcctactctctcacaatggtttaatgacatggtacccaaatatttgtgttgtctttggcaagacgagcaagctgtgggatgtgaaacactgagatttgaacggagacctacacaggattgtgtagcttaccaagcaccaggtgtagcaggagtctacggtgatccacactttgttactttcgacgatgtagaatatacgtttaatggaaagggagaattcgcattggtgaaatcagttacgcaaacggacaatctggaaatccaaggaagatttgagcaaatggaccctaacacttatggtgaggttagagctactcagctgacttctgtagtagctaaaggtaataacacaatagcaattgaagtcagaaggagacctctggattctagatggagatataggttggatgttatagcagataatagaagactttattttgatagaccctcactaaaattccagcacttccaaggtgttactatttacactccaagctacatccttaatcaatcagaagtcatcattatgtttgacaatggagctggaatggaggttgtcgacaatcaaggattcatgagtgcaagagtatttttgccttggtcgtttataaataaaaccataggcctttttggaaattggagttttaacaaagaagatgacttcacacttccagatggttctagagcagcaatagtgaataacataaatgacatggaaagggtttacaatgattttggttccaaatggatgttggaggatgtgttagatcctcaaaagggtagagcattgttccacagggaattcggaagaacttcagcgacttacaacaacaaaacgttcaagcctcaattcctaatgaatccggaagatttcctaccaaccaacagatctacagatcttaagcgaatatccgaaatatgtcctctaaagttgtacgaatgttactacgattacgctatgacggttgacagggatttggcgcattacaccaagaattataaagccacgatctatcaatataaagaaacgacaaggaggaaagttgtgtcttgcggagtactagaaacaccgagattcggacgaaagagtactttcctgttcgtgcccggtacgaaggttacctatgaatgcatccaagagttcgtgttggtaggtgatcagcggagagagtgtcaagcggatggaacatggaatattcctgaatacggatacacatattgcttacgtcagcaggaatactctcaacgacaagctggtttggcttccgggataattatggctattcttatcccgctcatcttgcttttcgtctacctggcgtatcgtttcttacaaagaaggcagaaagaaaaagaatctgaaaaattacaagagcaacagttcatggaatcacaaaggagagcccaagaagcagctactaagaaattaacagaagctgaatatgcttcagaagatgaagacagtaatgttacaagcacgggagcaaaagaaacaaccgtatactaacacctatagaatataatgattcaacctatgaattgtaatattttaaagtttaatctttgtcaaaactattatataaaataagtactatattatgttgtagttaatatttaataggacttttattttttattgtatttcagattatatttcatgcagagtgtgatttagattatatttcatgcaaagtgtagagtttcagatatagcctttttaaccacaacgtaatccgattcttatagtaaattcaacattatttaagatactttttcattgaattgtatacctatctaatcctgcaagacccacatatctttttcccaattaaaagagtaaataggaagatacgaaagcacaaagttaaaataaattaacgaatttcataaaacccagtagaaagctatgttctgcagttattatctaaattagaatactattaagtaaccatatcacccttctcaagtttacattaacatcaagatctactggtggcatccataggtaggtgcctactcgtatatttagtaaacaacagtttgttgatccatcaacttcttgttggtaagattcagctcaacgttgagggcaaccggcccttcttcttaaagttccatcttctatcagaggttggatatcataatgggtttggtcactatgttggctgctgctctgaatagttgtaataaactacagttaaaccattatctaaggttctttagccaggagatgcgtcttcttccttggatccttccttgcataataattctcagcaactcatatttttctcctctggtaatgtgacccaaatattccagttttctatgtttttatactgttcataatttctaactccttatttaaacgtcgtagcacttcaacattggtaatcctttgaacccactgaattttcaatattcttctgtaacaccacatttcgaacgcttctatttttcttatgtgttgtctcttcaacgtccaagcttccattccgtatagtaatatagaaaatatgtagcatcttagagccctcaatctgagaggcaactgaaggtctttgtttgtaagcagtgtcttcatttataaatgcttgccttgcagtttcaattcggactttaatttctttgctttggtcatttttgtcatcaacccaggttcccagatatttatatgtctaactttttctatttgggtttgctctctatcattaacctttcatttccatgttgtgtttttgagacaatcataaatttagtttttttcttgtttatttttagtccgtatcgaatgcaataatcgttaattctatttagcaattcttgtagcgatcccagggtgtctgccattataaggatgtcatcagcgaatcttgtgttatttactatttttccgtttatagagattctatcacttagctccgctatcgcttcctgaaatatggcttcactgtacacgttaaacagtagcggcgacagaacacaaccctgtcttactcctctctttatatcaatattctcggattcttgttcttctatctttatattggccttttgattccaatacagattgatgataattcgcaaatctcgtaaaaaagcagctctcatttaatttaacgaagaaccatgtgtaggaaacccatcagcagaatgtagcaggctctggttgccaataataaagaagtcagcaacaagaatataccaacattaacggattagtagaaagttggggtcacttcttcttttggcatgataagcctagatgggtctttgcctgtctggctatgttccattcagatctctcttgtgctcttctccattgtctgttc

SEQ ID NO: 5 - DNA, 446 bp, Diabrotica virgifera
  misc_feature (1)..(446): RNAi target sequence
aagagtagcgatgggtggtttacctcaaggaggaatattaagccctttgttatatttaatttacacttctgatatagaaaaaaatttaaactcaacaaaaattttacaatttgcagatgatgtagttatttatcaagaaaacattaaaatagaaaatgcagtcaaatccattgaagaaggagacaaacatattaaaatatggagtgaattacatggactaaatatatctgattccaaaaccaaattatgtatttttacaagaaaacgaaaagaaatacccaatcacatcttaataaacaatatatcctatcctgtacaaagttatgttaaatatttgggtattactctggatagacagcttctctggaaagaacatatagacaatatagttaaaaaaacagaaaaaggaataaaccttcttcgattcgtatcacacttacgttggg

SEQ ID NO: 6 - DNA, 22 bp, Artificial Sequence
  primer
  misc_feature (1)..(22): forward primer
aagagtagcgatgggtggttta

SEQ ID NO: 7 - DNA, 22 bp, Artificial Sequence
  primer
  misc_feature (1)..(22): reverse primer
cccaacgtaagtgtgatacgaa

SEQ ID NO: 8 - DNA, 7388 bp, Diabrotica virgifera
  misc_feature (1)..(7388): WCRW transcript ta0145.001_diavv
catatattccaacgttttttactcaaaagaaaggtagttataaaattaggtagataaagagatagaagataatgatttattatcattaattaaacctagatttggaattaaattcgaagtattacatgtaaaaagaattatgcggaaagtgattcaagataatggtaatactaattatagtaaaaacaggaaccgtaattgtcacttttaaaggtcagtctataccaaaaaatgtaataatagaaaaaaatgatatacgaggtggaaaattatacacccagaataatccaatgtttaaagtgtttgagatttgggcatataagtgcccaatgtagaggaaaagataggtgtgaaagatgtggcgaagaacacaacaaatctaattgttccaatccgaataatttactttgtgtattgtgcaaaggaaaacacagcgctactgacaagggagcagattgtacagaaagacaaaaacaggaatatattaaaaaaattatgaataatgaaaatataacatattatgaagctaataataaatataaaaaatgttattcaacagtaagtaaagaccaagaaaatacttcaaataaatatacaatatctaaacgaaaaagatcaagtagtattgattctagtagtgtagataaagaaacaatggaagcacgcagaaaaattttgcaaacaccaagaatacaaagtcagccttgttataattttaataatcccatttattctaacacaacacaaacacaaaacgataatcaaaataatataggagaaataatagtaaactttatttcagcaacattaaatcaaattaatcacaatttagatcaaaaaacgttggaattattaaaaaacaatatttcacaattattattacctcgtgatggctaacgtttcatttcttcaatggaatgcgagatcaattaaaacaaataagggttatttagaaaaattcttgtatgacaataaaatagatataggattaatatcagaaacttggttaaaaaaaagtaattttattaactttactggttacaatgtctttaggaatgatagagatgatggatatggtggagtagccatcccttccaaaaaattaataaaattttacaacagtcctacttttcaccaaattaatgacataatgtgcaatagcatatcaattaaaattcaatccggaaaaaagttaaacatttattcaatatacgtaaaaccaaatcttaaaatcactctaaatgaatggaaaaagttttttaatagtctagagaagccttttataattggtggtgattttaatagccacaattatgtttggggttgtagtactgtagatactataggaaaaaatctgttagaagctattgaggactgtaatcttgtaattttaaataatggtaaagaaactttgatgcgtagaccgaatagcaataataaatctgcaatagatcttacaatatgctcagcaaatattagtcattttttcgattgggatgttgtggacgagacattaggatcaaatcattttgctattattattaagtcaaatattaatgttaataaagcggaatgtgtaaatacaaaattccaatggaacataaataaagcggattggtctcttttctcttctatcactgataatttcatggaaatagataataatttaaattaccaacaatttttaaataaattaaacgaatattgtaagatatgtataccggagaagagaacagggactaatccacgatttagaaaaacttggtggaatgacaattgtaaaaaggtaatagaagaacaaaaactagctttacgcaagtttaaactacagtctaatatacaaaattatataaattataataaatgtgtagcgaaaaccaaaaaagttgtattagagagtaagcgtaatgcatggagaaatttttgtaaaactttaaacaaaaatacaccaattaaagatatgtggaatcaagccaaacgattacaaaacatttttaaaccacaagtaaatccagtgactgaaggagaatgggttgaggagtttttaagaaaattatgtccagataatatattttcaaaaattaatgtaatggaaagaaaaaactctatgcatccactttcaattccatttagtttctgtgaattagaaataagccttaagaataagaaaaatacttctccaggtatagataatgtacattatattatgttggccaatttacatcaaaaagggaaagaaacactattaaatttttttaatcaaatatggttatcagaagatattccagataactggagagagtaccgggtgattcctattctcaaaacaaatcggaatcctgattcagcagaatcttatagaggtatttcattgagctcctgcataacaaaaacactggaaagaatgataaaacttaggctcgaaagttggctagaaaaaaacaataaattatcacaaacacaatttggatttcgaaaaaatcattctactgtggaagctgtgagtcatttggtaacagatataaatttagcgtttacgaaaaattcttcagtaatcgctcttttattagatgttgaagcagcatacgacaacgttaatttaaatatactatataacaaaatgatacaaataggtctgccagaatgcttctgtcaaaaaataataaaattgtatgactgtagaaaaatttatatatcggtaaataataacacatttggtccaagagtagcgatgggtggtttacctcaaggaggaatattaagccctttgttatatttaatttacacttctgatatagaaaaaaatttaaactcaacaaaaattttacaatttgcagatgatatagttatttatcaagaaaacattaaaatagaaaatgcagtcaaatccattgaagaaggagacaaacatattaaaatatggagtgaattacatggactaaatatatctgattccaaaaccaaattatgtatttttacaagaaaacgaaaagaaatacccaatcacatcttaataaacaatatatcctatcctgtacaaagttatgttaaatatttgggtattactctggatagacagcttctctggaaagaacatatagaccatatagttaaaaaaacagaaaaaggaataaaccttcttcgattcgtatcacacttacgttggggagcagatccaaatatttctttgttgttatttaaaaataatataagagctatattcgactacggatcaatattatacagtgacgcatcacagtgtcatttaaataaaatagacaaaatcattaataaatcccttagattgtgtataggagccctaagaagtacaccgataaataatctacaagttgaatgctgtgaaatgccgatggatataagacgaaaaaaacttggcatcaaccttttagttagattgtatgaaaaaaaggcaagtttaatttccaaaatacatcaactgtttttagcagacttgacagaaaaatattggataaaaaagaaaactctaaatatggtagatttatattcaaaaatgacaatatatgataaacaactttataaatatgacataaacccaaattataatattgactttaatagtatggaacaagttcaggtatactttttaagggactatagcaagttgcctatatctttaagaaaattagtgtttatctccgacagttcacaaatgttcaaagattattgtatgctatatacagatgcatcaaaaaatattgaaggtgtgggatgtgcctattgggatagcagtaataaaattagtaaaatgtttaaactaaattctattatgagtatatacacagctgaattaatagcgataatggaagcactaaaatatttatctaatataaatcattcaaagtttataatttttagtgacagtaaaagttctcttagtaaaattagtgctataaatcctaaatcaaaagtgaactacattgaattatatatcataaataaaattaaagaacttcagcaacaaggaaagtctgttaagttggcatgggttaaaagccactgtggaataactggaaatgaaatggtagatgaattggctaaaaacgcggtgacacaaggagtattaacccattatctttgtacgccaaaagatattgaatcaaatttattcaaagagattaagaaagaatggaaagaaaggtatattgatgaaaacgtaaatacaggaaaccactacagatcaatcagaaactatataacggataaaccttggttttctaaaatggagtcgacaaaagatatgataagaaccatatgcagaatgagatttgaccactgtcttactccatcatatttatttaaaattaatatagctgatagtccacaatgtatttgtggacagttgggcaatctacaacacaaaattttgacctgttctcttatctctaataaagttaatatgtttttaaattcactgtattctttgactgatgtccaccatcccattaatttaaattatttattaacattagaaaataatgagttggtataccgactattgtataaacatattttagatattaagcttaaattgtaattgtaaaatatagagtaagtatttcttgtaaattgttatatgttaaaagaaaaagaaaagaaaagaaaaaaaaagaaaagaaatataaaaaaataataaaataaaataaaaaaaaaaataataaataaataaaaaaataataaaaaaagaaagaaaaaatataaaaaagatatataaaaaaaatagaaaaaaaaatataataattaaaaaaatataaaaaaaaatatgtagataaaaatgaatgacgaacttggacagtccatagtaaaatagctttcgaatgaagtagagggctaaagaagaatgttgcagtttttgctgtggaactctgagaacatcatttggaaaaaaattaataaaatatatatataataaaaattattaaaaaaaatacaaaaataattatttattagtagaattgtttattatattagtattagttttaggataagatacgaaaaaatgactaataaaataaaaaatagtaaaattggcgaatggatttagtgtccgcagtcatataaacccaaacaaacaacaaaagatcaacgaataccataaatctgagtaatattaattgatttttgaagaaatcgtgtcaaaattatttttattatcaatctaatagtaaacttaaagccagtagaagaacaaccggtttttactggacattatttagaccagtcaaatggtttaggttctatatgagtagaataacaagttaaaacaattatatattatcaaaaaattgaaaaaaggatcggctattttatggtaaagggttttttggtcaatttacttattaaatgttaaggaggtaaacattttaaaatggaataaattgttaatcaatttaaaaaaaaaattctacgagttttaaatttgcgtcaaaaggaggcttttgtagtggaaaatatgtgataaaaatttcaaaactattcgttaaatagtttttaaacaattcaatttgcttattataactttgcgaaaatgaagaatcttttacaactaaaaatattttaccacatctcattttgaaggtttttcaataaatcaaccgattcttttatcagtttttttgataaactatataacaaacatcagcattttgcaaggattgagactattgatgggagcacatgttatccacttattttactttttataatacaatattacaataaatctaacttaaaatataaaatttgggatatggcatttaaaaatattaatttcattaccgccgaatttagatttagatgcgcttaaattcattaataaaatttagattaaaccattacttgaactagctttacaaacaaagagagcaacagaatttgaccaaaaaatatatacacctgcttatgagatcagtcagtggcgtgaagcatgtacgtgatcgcgatcatgactgggacagcgatcacataatagggcttttcattcacaatcatttgtttcgagcttctgtcatgtgtcacataatattaatatacagggtgagtcatgaggactcctacctcgtatagaggcccctatggggaacaacaaacgaccactaaaaagtgtctgctcccattgttcaacaatatacagggcgagttcgcattttgacagaaattcatattcgtcacaattcctgaacggtcagatcgatgtgtctcccattctggccaatcgccacactactaccacccaatcaactaattcattcaaactagaaaaaaacaaggcccgccccaaaaaaattagttcgtttgggtcccagaaaaaacttcaccctgtatacactccttgaaaactccaatatgaattttacaaattagacaaataggcaattaaaatggcatatttatttttttccccacacgactactcaatttttattaaaaaatcaaatttgtcaaaatcggaattttaacctaaaaataaaaaaaattaaatcagcgtttaactcgctacaactctgttccattttaatatttttttctgaaatttttacagcacatacctcttaccattgtgaagactatgaaaaattgttgtagactttcagtcttcttctcgtaaaagttatgaatttttaaaaataaaaggtgcagattcgtgaattgcaaagttaaatcgcaaaaattaagtgaaaaaatttaaaatttatctatttgatcacgtctatgttaaactatagagtcccaaaagaagtgttatgggaagttttagatctagacatgttatagaaaaaaaaaatggtaaaacttttaatttgaggaaaaatgttgtttttgtaaattaatttttgtgaaaatcgttaatttttttaaatctatgcaaaaactttgccaaactttttatgcatagtcaaatttgattttttaactaaaaaactaagtaatcgtgtggggaaaaaataaatatgccatttcaatcgcctacctgtctccctgtaaaattcatattagagccctctaaaaaacgttatttttactttttaaggtttttcgttttaaattttttcctaagacccaaacaaactaatttttcaaatccgggcctgatttctctccagtttgaacaaatcagccgattgggtgataacacaaattaaatatttgctcaaaaaaattcatttttgtaataaaagctatttttttcaatgcatggttgactttaccaaactttcaattattcatagtcaaatttgatttttttataaaaaatcaagtaatcgtgtagggaaaaaataatatggaacagagttgtagcgagttaaaccgtgagttcatttttttttcatttttaggttaaaattccg

SEQ ID NO: 9 - DNA, 445 bp, Diabrotica virgifera
  misc_feature (1)..(445): RNAi target sequence
gtttcgtttcatcatcatttgttgtaatttttgtagtaaagcacattaaaaaaaaaatctgttttaaagccatggctgatgaagaatttgacgaaaatgatgtagcagatgatttcgatgacgacgtagaggatgataatatcgaagaactcgaacaacccgaggaagatggagataacatcgatatccttgctccaggacaagcaggaggtggtgtaccaaaaaacaagaggataacaactaaatatatgaccaaatatgagagagccagagtattaggtactagagccttgcaaatagccatgtgtgccccagttatggttgaactagatggtgaaactgatcctctgcaaattgccatgaaggaattaaaacagagaaagattccaattattattagaagatatttacctgaccattcctatgaagattggggaatagacga

SEQ ID NO: 10 - DNA, 20 bp, Artificial Sequence
  primer
  misc_feature (1)..(20): forward primer
gtttcgtttcatcatcattt

SEQ ID NO: 11 - DNA, 22 bp, Artificial Sequence
  primer
  misc_feature (1)..(22): reverse primer
tcgtctattccccaatcttcat

SEQ ID NO: 12 - DNA, 544 bp, Diabrotica virgifera
  misc_feature (1)..(544): WCRW transcript ta02059.001_diavv
ggtttcgtttcatcatcatttgttgtaatttttgtagtaaagcacattaaaaaaaaaatctgttttaaagccatggctgatgaagaatttgacgaaaatgatgtagcagatgatttcgatgacgacgtagaggatgataatatcgaagaactcgaacaacccgaggaagatggagataacatcgatatccttgctccaggacaagcaggaggtggtgtaccaaaaaacaagaggataacaactaaatatatgaccaaatatgagagagccagagtattaggtactagagccttgcaaatagccatgtgtgccccagttatggttgaactagatggtgaaactgatcctctgcaaattgccatgaaggaattaaaacagagaaagattccaattattattagaagatatttacctgaccattcctatgaagattggggaatagacgagctcattattatagatcactagattgtaatttttatgtggatattatttaatacataggtttttataacaaaaaaaaaaaaaaaaaaaaaaaaaaaaa

SEQ ID NO: 13 - DNA, 563 bp, Diabrotica virgifera
  misc_feature (1)..(563): RNAi target sequence
ttggtgattctggtgtaggaaaaagtaacttattgtcaagatttactagaaatgaattcaatttggagtctaaatctactataggtgtcgaattcgctaccagaagtatacaggtggatggtaaaactattaaagcacaaatatgggacacggcaggtcaagagagataccgagcaatcacggcggcctattatcgtggtgcagtcggtgctctactcgtctacgatatcgccaaacatctgacatacgaaaacgttgaacgttggttgcgcgaattgcgcgaccacgcagatcagaacattgtgatcatgttggtcggaaacaaatccgatctgaggcatttgcgcgccgtgctgacagaagaagctaaggctttcgccgaaagaaacggcctcagcttcatcgagacttcagccctagattcgaccaatgtcgataatgctttccaaaatatactcacagagatctatagaattgtttcccaaaaacagatcagagaccctccggaaaataatatgatgccccaacacatgatgaaccaaaaaatgatgcaaccagacatg

SEQ ID NO: 14 - DNA, 22 bp, Artificial Sequence
  primer
  misc_feature (1)..(22): forward primer
ttggtgattctggtgtaggaaa

SEQ ID NO: 15 - DNA, 22 bp, Artificial Sequence
  primer
  misc_feature (1)..(22): reverse primer
catgtctggttgcatcattttt

SEQ ID NO: 16 - DNA, 689 bp, Diabrotica virgifera
  misc_feature (1)..(689): WCRW transcript ta47051.001_diavv
agttgtccttattggtgattctggtgtaggaaaaagtaacttattgtcaagatttactagaaatgaattcaatttggagtctaaatctactataggtgtcgaattcgctaccagaagtatacaggtggatggtaaaactattaaagcacaaatatgggacacggcaggtcaagagagataccgagcaatcacggcggcctattatcgtggtgcagtcggtgctctactcgtctacgatatcgccaaacatctgacatacgaaaacgttgaacgttggttgcgcgaattgcgcgaccacgcagatcagaacattgtgatcatgttggtcggaaacaaatccgatctgaggcatttgcgcgccgtgctgacagaagaagctaaggctttcgccgaaagaaacggcctcagcttcatcgagacttcagccctagattcgaccaatgtcgataatgctttccaaaatatactcacagagatctatagaattgtttcccaaaaacagatcagagaccctccggaaaataatatgatgccccaacacatgatgaaccaaaaaatgatgcaaccagacatgatgatgaataacgaaatgatgaacgaaaaaatgatgatgccccaacacatgatgaaccaaaaaatgatgcaaccagacatgatgatgaataacgaaatgatgaacgaaaaaatga

SEQ ID NO: 17 - DNA, 204 bp, Diabrotica virgifera
  misc_feature (1)..(204): RNAi target sequence
cccaatgccgagatatattgataccgaacaaggcggatcccaagccagatttttgttgtcgaaagtaaatccaagtcaaactcataacaacatgtattcctacggaggtgattctggagctccagttttgacagatgatgtatcccttcaagtattcatggaccatctaaagaaattggcagtttcgtccacagcataatacct

SEQ ID NO: 18 - DNA, 20 bp, Artificial Sequence
  primer
  misc_feature (1)..(20): forward primer
cccaatgccgagatatattg

SEQ ID NO: 19 - DNA, 20 bp, Artificial Sequence
  primer
  misc_feature (1)..(20): reverse primer
aggtattatgctgtggacga

SEQ ID NO: 20 - DNA, 2636 bp, Diabrotica virgifera
  misc_feature (1)..(2636): WCRW transcript ta01733.001_diavv
gcacgaggcagacacgacatcgaatgacgtggaagttcaaattctgaaacaattaggtgtaatttttaggagctcaataatagtgttatttacatgatagaatcctaataatatatattgaggaatttccttagggaattccgacttgtaatcttcaaaaatgagcacatatgaagagtatatacaacaaaatgaagatcgagatgggattagatttacctggaatgtatggccttcaagcagaattgaagctacccgtctcgtagtacccttagcttgtctgtaccagcctataaaggaacgtctggatcttccaccaatacaatatgaccctgttttatgtactagaaatacttgtagagcaatattaaacccactgtgtcaggtagattatcgagcaaaactctgggtatgcaacttttgtttccagagaaatccatttccacctcaatatgctgctatttcagaacaacatcaaccagcggaattgatgcctatgttttccaccattgaatacacaataactagagctcaatgtttaccaccaatatttttgtatgttgttgacacctgcatggatgatgaagaactgggttccctgaaagactcattgcaaatgtcccttagtttgttgccacctaatgcgttaataggactaataacatttgggaaaatggttcaagttcatgaacttggcactgaaggttgtagtaagtcatatgtgttcagaggtacaaaagatcttagtgctaaacaggttcaagaaatgctgggaataggcaaagtggctttaggtcagcaagcccctcaacagccagggcagcctctaagacctgggcaaatgcaacctactgttgttgcaccaggaagcaggtttctacaacctgtatccaaatgcgatatgaatctaacagacctaataggagaacaacagaaagatccttggcctgttcatcagggtaaaaggtatttaagatctacaggtgtagctttatcgattgccattggtttgttagaatgtacatattccaatactggcgcccgagttatgctatttgttggaggaccttgctcacaaggacctggtcaggtagttaatgatgatttaaaacagcctattagatcacatcatgatattcagaaagataatgcaaaatatatgaagaaaggtattaaacattatgatgcgttagcaatgagagccgcaactaatggtcactctgttgatatttattcttgtgctttggatcagacaggtctgatggaaatgaagcaatgctgtaattctactgggggacacatggtaatgggggattcatttaattcttccttgtttaagcaaactttccaacgtgtgtttaccagagatcaaaaaagtgatctgaaaatggcatttaacggtactttggaagtgaagtgttcccgagaattaaaagttcaaggaggtatcggttcgtgtgtatcacttaacgtgaagagccccttggtttccgacacagaaataggaatgggtaatactgtgcaatggaaaatgtgtactttaacgccaagtactaccatgtctttattctttgaggtcgtaaatcaacattctgctcccatacctcaaggtggtagaggttgtatacaatttattacgcagtaccagcattcaagtggtcaaagaaaaatcagagtaacaacagtggctcgaaattgggctgacgcaactgctaatatacaccatatcagtgccggattcgatcaagaagctgctgctgtaataatggctaggatggccgtttatagggcagaatctgatgatagtccagatgttcttagatgggttgacagaatgctgattagattgtgtcaaaaattcggagaatacaataaggacgaccccaattcattcagacttggtcaaaacttcagtctttacccacagttcatgtatcacttaagaagatctcaatttcttcaagtattcaataattctccggacgagacttcattctacagacacatgttgatgagggaagatcttactcaatctttgataatgattcaacctattttgtatagttatagtttcaatggtccaccagagcctgtattactagatactagctccattcaacctgacagaatattacttatggatactttcttccaaatattaattttccatggagagactatcgcccaatggcgtagtttaaaatatcaagacatgccagaatatgaaaactttagacagctactacaggctccagtagatgatgcacaagaaattttgcaaactaggttcccaatgccgagatatattgataccgaacaaggcggatcccaagccagatttttgttgtcgaaagtaaatccaagtcaaactcataacaacatgtattcctacggaggtgattctggagctccagttttgacagatgatgtatcccttcaagtattcatggaccatctaaagaaattggcagtttcgtccacagcataatacctatatattacaattagatacatttgacataatacagtttttgaatttattcaatatattatattttaagcttaatttttttgtatatttatttcatagatagtttatatatttggtaatgtgatacaataaatttttgttttcc

SEQ ID NO: 21 - DNA, 599 bp, Diabrotica virgifera
  misc_feature (1)..(599): RNAi target sequence
acaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttg

SEQ ID NO: 22 - DNA, 22 bp, Artificial Sequence
  primer
  misc_feature (1)..(22): forward primer
acaaatgtggtggtatcgacaa

SEQ ID NO: 23 - DNA, 22 bp, Artificial Sequence
  primer
  misc_feature (1)..(22): reverse primer
caagcactttccttcagctttt

SEQ ID NO: 24 - DNA, 1698 bp, Diabrotica virgifera
  misc_feature (1)..(1698): WCRW transcript ta04714.004_diavv
gggatcttcctttttaatttgctcgtcgtacggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttcccccatctcgtccaactgagaaacccctccgtcttccactccaggatgtctacaaaattggtggtattggaacagtacctgtaggtcgtgttgaaactggtgtattgaaacctggtatggttgtagtattcgctccagccaatttgacgactgaagtaaaatccgttgaaatgcatcacgaagccctccaggaagcagtacctggtgacaatgttggtttcaacgtcaagaatgtctctgttaaagaattgcgtcgtggttacgtagctggagacaccaagaacaacccacccagaggagcttcagacttcactgcccaagtcattgttctcaaccaccctggtcaaatctcaaacggatatacccctgtactcgactgtcacacagctcacattgcctgcaaattcgctgaaatcaaagaaaaggttgaccgtcgttctggtaagaccactgaagaaaatcccaaagccatcaaatctggtgatgccgccattgtcaacttggtacccaccaagcccatgtgtgtagaatcattccaagaattcccaccccttggacgttttgctgtccgtgacatgaggcaaaccgttgcagtaggagtcatcaagagcgttgccttcaaagatcccagcgccggaaaagtcacaaaagctgcagaaaaagcccaaaagaagaaatagtctatttggactccactacttaaataattttgatatgttttgtttcttttatatattaatattggagtatcaatgtatttttaataactaatggacttattacttgcattgcattatttgtgatctgtaaattaaacttggacaaataaagaaaaaaattaaaaaaaaaaaaaaaaaa

SEQ ID NO: 25 - DNA, 550 bp, Diabrotica virgifera
  misc_feature (1)..(550): RNAi target sequence
ccagggaaagagagaagtacgataatttagcagatttgtatgctgtaataaacactttgcaacaattagagaaggcatatattcgagattgtgtagtggcaaaggaatatacaggagcttgtagtaaattattagttcagtataaggctgcgtttcgacaagtcaagagtgatgaatttcctacaccagacgcctttgttaagaagtacaggcttgactgtcctgcagctttagaacgtatcaaggaagataggccaatcactatcaaagacgacaaaggcaacactagtcgatgcattgctgatatcgtatcgctattcatcactataatggacaaactgcggttggacattcgttcgatggataacttacatcctgacgtgagggacttagtagatactatgaacagacttagcattctgccatcggatttcgatggaaaggtaaaagtggctgaatggttaaatactttaaatgaaatgcaggcctctgatgaattatccgaagctcaagtgaggcaactgttgtttgatcttgaaagtgcgtatgc

SEQ ID NO: 26 - DNA, 22 bp, Artificial Sequence
  primer
  misc_feature (1)..(22): forward primer
ccagggaaagagagaagtacga

SEQ ID NO: 27 - DNA, 22 bp, Artificial Sequence
  primer
  misc_feature (1)..(22): reverse primer
gcatacgcactttcaagatcaa

SEQ ID NO: 28 - DNA, 769 bp, Diabrotica virgifera
  misc_feature (1)..(769): WCRW transcript ta01620.001_diavv
atataaatagaaaaatgtcagcagaaaatcgccctgagctgtatgaggaagtcaagctatatcacaatgccagggaaagagagaagtacgataatttagcagatttgtatgctgtaataaacactttgcaacaattagagaaggcatatattcgagattgtgtagtggcaaaggaatatacaggagcttgtagtaaattattagttcagtataaggctgcgtttcgacaagtcaagagtgatgaatttcctacaccagacgcctttgttaagaagtacaggcttgactgtcctgcagctttagaacgtatcaaggaagataggccaatcactatcaaagacgacaaaggcaacactagtcgatgcattgctgatatcgtatcgctattcatcactataatggacaaactgcggttggacattcgttcgatggataacttacatcctgacgtgagggacttagtagatactatgaacagacttagcattctgccatcggatttcgatggaaaggtaaaagtggctgaatggttaaatactttaaatgaaatgcaggcctctgatgaattatccgaagctcaagtgaggcaactgttgtttgatcttgaaagtgcgtatgcgtcctttaataaagtccttcataattctgcctaaatgtacgagatagttgttatgattgttacacgtttatgtaaatattataagcaaaaaaaattgagctagatagttattggcaatgtatgcatttatcaattttaaccctaattgga

SEQ ID NO: 29 - DNA, 578 bp, Diabrotica virgifera
  misc_feature (1)..(578): RNAi target sequence
aatccaaaagctgaagtggctagagctgcacaagccctagccgttaatatatcagcggcaaaaggcattcaagatgtaatgaagtcaaaccttggtcccaaaggaacagtgaaaatgttggtatctggtgccggcgatataaaaataaccaaagatggaaacgttctattgcacgaaatgcaaattcaacaccccacggcttcccttattgctcgagcctcaactgcccaagatgatatgaccggcgacggcactacatcgactgtgttagtcataggtgaactattaaaacaagcagatatttacatagcagaaggtctccaccctagattgttaacagatggctttgataaggctaggacaaaagcgttggaagtactggagaaaatgaagatttcaattgaagcgaacaaagaaactttaacagatatttgcaggacgagtttaagaacaaagctgcatcaaaaactggctgatgttttgacagacgtttgtgtggatgctgttctagctataaagaaagatggcaaacctgttgatcttcatatggttgaattaatggaaatgcagcacaaaac

SEQ ID NO: 30 - DNA, 20 bp, Artificial Sequence
  primer
  misc_feature (1)..(20): forward primer
aatccaaaagctgaagtggc

SEQ ID NO: 31 - DNA, 20 bp, Artificial Sequence
  primer
  misc_feature (1)..(20): reverse primer
gttttgtgctgcatttccat

SEQ ID NO: 32 - DNA, 1864 bp, Diabrotica virgifera
  misc_feature (1)..(1864): WCRW transcript ta00896.001_diavv
gggggtcaaaaattttgggttggctcaacacgagttttctattttatttgaaaaaatagtattttaaataatggctatcagtttgttaaatccaaaagctgaagtggctagagctgcacaagccctagccgttaatatatcagcggcaaaaggcattcaagatgtaatgaagtcaaaccttggtcccaaaggaacagtgaaaatgttggtatctggtgccggcgatataaaaataaccaaagatggaaacgttctattgcacgaaatgcaaattcaacaccccacggcttcccttattgctcgagcctcaactgcccaagatgatatgaccggcgacggcactacatcgactgtgttagtcataggtgaactattaaaacaagcagatatttacatagcagaaggtctccaccctagattgttaacagatggctttgataaggctaggacaaaagcgttggaagtactggagaaaatgaagatttcaattgaagcgaacaaagaaactttaacagatatttgcaggacgagtttaagaacaaagctgcatcaaaaactggctgatgttttgacagacgtttgtgtggatgctgttctagctataaagaaagatggcaaacctgttgatcttcatatggttgaattaatggaaatgcagcacaaaacagaaacagatactcagttaattaagggtttagtcctggaccatggctcccgtcatccagatatgcctaaaagtctcaacaactgctacattttaacatgtaatgtcagcatggaatatgaaaaaagtgaagtcaattcaggattcttctacaaaactgcagaagagagagaaaaattagtgactgcagagcgtgaattcattgagcagagagttaagaaagtcattgaactgaaaaggtcactctgtaatggaactgataagacttttgttgttattaaccaaaaaggtattgaccccatgagcctggatatgcttgccaaagaaggaataatagctctcagaagagctaagagacgtaacatggagcgtctatcattggcttgtggtggagtagctatgaacagctttgatgatctgcaagaatctcaacttggtagagccggacatgtatatgaacatgtgttgggagaaaataagtatacatttgtggaagattgcaaaattcctcaatcagttactattttaatgaaagggccaaataaacatactttgactcagattaaagatgcagttagagatggattaagggctatcaataatgccattgacgataaagcagttattccaggtgctggtgcatttgaagtcacagccaataaagaattgctagcatttaaagacactgttaagggtaaagctcgtctaggagttgccgcttatgcagaagctttactggtagttcccaagactttggctgttaactctggatttgatgcacaggacaccattctaaaactacaagaagaatcccgtttgaatccagacccaatcggtttagatctaacctctggggaacccatcaatcctaaagatgctggcatctatgacaactatattgttaaaaaacaaataatcaattcctgttcggtcattgccagcaacctcttattggttgatgaaattatgagggctggaatgagcagcttaaagggataaaatcgaagtattcaaatttaaatctgtatttttgtgcttgttttaatttatcattacattatgtattttcttaacctctgaaaggttgctacttaatatttagtggacatacacataatgctgtaacgttgataacatacacacgtaacatttataatatttgcaataataaaatgtcaaaaaaaaaaaaaaaaaatgcga

SEQ ID NO: 33 - DNA, 709 bp, Diabrotica virgifera
  misc_feature (1)..(709): RNAi target sequence
gaaaatgccaaccaaagtcttcgagaagagctgtcctttaaggatcagatccatcaacaacagttgacagaaactcgtactcgtcgtcaagtagaaatcagcgaaatcgacggtcgcctggcagaaaaatatgaggctaagcttcaagaggctctacaagaactcagagatcaatatgaaagtcaaatggccaacaaccgtggcgaaatcgagttgctttacgaacagaagattaagaacttgcaatcagctaatgacagacatgctgcctctgcctccggtgctcttgacgaattgagacaagttagaaccagaatcgatactttgaattctcgaattagcgatttagagaaccagaacgctggcttagcagctcgtgctagagatttggagaagttgttagagaatgagcgcatgcgccatgtggaagacctcgcaatgttagaaagagaattgcatagactccgagaagaaatggctaatcaacttcaagaataccaggatcttatggacattaaggtttctcttgatttagagatagctgcttatcggaaactgctcgaatctgaagaagctcgtcttaatattaccccaacaggtagtgaagttcatgaagtaactcacagtaggagccaacgcagctcgtcgcaacgtcgcactccagtcagattgggagccaaaagaaagcgaacactactcgaagaaagcc

SEQ ID NO: 34 - DNA, 22 bp, Artificial Sequence
  primer
  misc_feature (1)..(22): forward primer
gaaaatgccaaccaaagtcttc

SEQ ID NO: 35 - DNA, 22 bp, Artificial Sequence
  primer
  misc_feature (1)..(22): reverse primer
ggctttcttcgagtagtgttcg

SEQ ID NO: 36 - DNA, 2662 bp, Diabrotica virgifera
  misc_feature (1)..(2662): WCRW transcript ta03354.001_diavv
aaaaaccgttaaacgccgctcccatcatatcatctccaaaaatagtttgattacctcgggtagaccgcgacataatttgtgcttcgaccgatctctctctttgagttgtcgcttttcgaggtatttagttgcaggcgtggtgtatacgttgaaatagtgatttttgttaaaagtgagtaaatatggcatcgaaatcaaaaaaagggtcaacaccgttagcttcacagcggccggcgagccccttaagtcctaccagacattctagattacaggagaagcatgaacttcagaatcttaacgaccgtttggcgggatatatagatcgagtaaggtatttagaaggtgaaaacaacagattaacgagggaaatacaaagtacccaggaaacagtaacaagggaagtttcaaacattaaatctatgtatgaccatgaattatcagatgctagaaaactattagacgagacccaccgtgaaaaagcacgtttagagatagatgttaaacgtcttttagaagagaatgacgaactcaagtctgagttagcaaagaagaacaaggatttggctctagctgagaattctgccaggatatacgagaccagatgtaacgagttacagctcaaagcaaatcaagcggctgctgatgctaagaaagctattgcagatgctaaggaacttgagaaagaacgtgataagctacgcaaacttcttgataatcatcgtaaacagttagaagaagaatcattagcgagagtggaagtcgaaaatgccaaccaaagtcttcgagaagagctgtcctttaaggatcagatccatcaacaacagttgacagaaactcgtactcgtcgtcaagtagaaatcagcgaaatcgacggtcgcctggcagaaaaatatgaggctaagcttcaagaggctctacaagaactcagagatcaatatgaaagtcaaatggccaacaaccgtggcgaaatcgagttgctttacgaacagaagattaagaacttgcaatcagctaatgacagacatgctgcctctgcctccggtgctcttgacgaattgagacaagttagaaccagaatcgatactttgaattctcgaattagcgatttagagaaccagaacgctggcttagcagctcgtgctagagatttggagaagttgttagagaatgagcgcatgcgccatgtggaagacctcgcaatgttagaaagagaattgcatagactccgagaagaaatggctaatcaacttcaagaataccaggatcttatggacattaaggtttctcttgatttagagatagctgcttatcggaaactgctcgaatctgaagaagctcgtcttaatattaccccaacaggtagtgaagttcatgaagtaactcacagtaggagccaacgcagctcgtcgcaacgtcgcactccagtcagattgggagccaaaagaaagcgaacactactcgaagaaagccaagagtcaagcatgaatgactatacggtgaacagctcctcaaaaggtgacattgaagtcgctgatgtcgatccagaaggacactatgttaagttgcacaataaaagtaatcaagaagtcgcacttggaggatggcaagtcattagacgtgttggtgaggaggaaactacattcaaatttcacaggtcactaaagcttgaaggtaatggatttgtaacaatatggagctctgacctcaacaaagatcatgaacctccaactaatttagttatgaagagtcagaaatgggttgtaggtgataacatggtcaccacattattgaataataacggagatgaagtagctgtctccgaaagagttaaaaggcaattaacaagctcccatctaagacacagagaactagcagctggctacctctcagaagaactccaccatcaacagggtgatccacaagtagatgaaagatgtaggcttatgtaaagttaacacatctcatttaatttttttatttacagttaaggttggaatgttacagaagtaggttgtgctccttacttacgctttttaaactattttttaagtgatgttcttaatattataagattctaggacagaaggaacacaacttatactgttattgacaaaaaacttactgaaaattgcaattagacaacagtagtaagtttaatactaagaatacaggatgaggtaataattattattctttatataaactgtctttttaggagttttatatatattttttaaatatcttgcatataagtcttgaattacagttgtcatttttataaatttaaacctgaaaaatacattatttcgcattaatacctcatcctgttcgatagtttcttaagatagataacaaactgccagttcgataagttttcttttaactaacacaattgtttattagtataatataattttgaaaaattactgtactgttgtccccaaaacattaaagtgttctgcatttatttaaagaataataaactttttatattaatggtagttcttttgtttttgaggtttttcactcagctgtttacgcttgttttagttagataggtgttgcaaaaactatagggataaaaatctagatttggtttcagttacttgtattatattttattgtatatctttattcttgatcttcgaaacttaaatctgta

SEQ ID NO: 37 - DNA, 635 bp, Diabrotica virgifera
  misc_feature (1)..(635): RNAi target sequence
aatggctttacacgtccctaaagcaccgggctttgcccagatgttaaaagaaggagccaggcactattctggtttggaagaagctgttataagaaacataatagcatgcaaggaatttgcacaatccgtaaaaactgcctatggtccaaatggtatgaataaaatggtcattaatcacattgagaaacaatttgtcacaagtgatgcagctacaattatgcgagaactagatattgaacatccagcagccaaactcatgatactaggaagtcaaatgcaagattctgaggtgggtgatggaactaactttgtgattatacttgctggagcacttttggagcatgctgaagaactaattcgtcttggagtaactcccacagaaatagcagaaggttatgagaaagcactagacaaatgtctagaaatccttcctaatcttatttgctacacaatcaaggatttcagaaacatcgaagaagtcaaaaagggcatacaaacctcaattcaatctaagcagtatggcaatgaagagtttctatcaaaacttattgcagaagcttgtgtgtcaattttgccagaagaaacaacatttaatgttgataatgttagaatatgtaaagttttggggtctggtt

SEQ ID NO: 38 - DNA, 22 bp, Artificial Sequence
  primer
  misc_feature (1)..(22): forward primer
aatggctttacacgtccctaaa

SEQ ID NO: 39 - DNA, 22 bp, Artificial Sequence
  primer
  misc_feature (1)..(22): reverse primer
aaccagaccccaaaactttaca

SEQ ID NO: 40 - DNA, 1866 bp, Diabrotica virgifera
  misc_feature (1)..(1866): WCRW transcript ta04788.001_diavv
ggaactctatggtcttcagtcactctaaataaaatcctataaccttttttgggatttcaattcgaattaaataaatttcttcagaaacatacaagaaacaaatacagacaatggctttacacgtccctaaagcaccgggctttgcccagatgttaaaagaaggagccaggcactattctggtttggaagaagctgttataagaaacataatagcatgcaaggaatttgcacaatccgtaaaaactgcctatggtccaaatggtatgaataaaatggtcattaatcacattgagaaacaatttgtcacaagtgatgcagctacaattatgcgagaactagatatagaacacccagcagccaaactcatgatactaggaagtcaaatgcaagattctgaggtgggtgatggaactaactttgtgattatacttgctggagcacttttggagcatgctgaagaactaattcgtcttggagtaactcccacagaaatagcagaaggttatgagaaagcactagacaaatgtctagaaatccttcctaatcttatttgctacacaatcaaggatttcagaaacatcgaagaagtcaaaaagggcatacaaacctcaattcaatctaagcagtatggcaatgaagagtttctatcaaaacttattgcagaagcttgtgtgtcaattttgccagaagaaacaacatttaatgttgataatgttagaatatgtaaagttttggggtctggtttacataactctcaggttgtacaaggtatggttttcaaaagacaagttgaaggggaaataactaaagcagaaaaagctaaaattgctgtattcagctgtgctgttgatattatgcaaacagaaactaaaggaactgtacttatcaaaactgcagatgaacttatgaactttagtaggggagaagaaaatcttcttgaattacaaatcaaatgtatagcagatgctggagctaaagttgtagttgcaggagccaaatttggagatatggctctacattacttacataaatatggcatgatggttgtcaggttgaactccaaatttgatttgagaagattatgcaaaactgttggtgctacttgtcttccacgcctaacagctcccacatctcaagaacttggttacgcagatattgtatgtgtagaagaattgggtgatacccctatagtttctttcagattggagggcaaagaatcaagaatttccacaattgtcatcagaggtgctactgacaattacatggatgacattgaaagagcaattgatgatggagttaatacatttaagggaatctctcgagatggcagatttgttcctggtgccggcgccgttgaagcagagttagctgttcagctgactaaatatgcagacactcttccaggcttagaacagtatgctgtcagaaaattcgcatctgcccttgaaagttttcccaaaacgttggcagataatagtggacacaaatccacagcagtattagaaaaaatattggaagctcaccagaatggtcagaaaaatgttggagttgacatagaagctgaaagtgcagtatgtgacgctttggaaaagaacatcttggacctttatcaatgtaaatattggggactgaagtatgctgtaggagcagcagcaaccattttaagagtcgaccaaattattatggcgaaaagggcaggtgggccaaaagttaggcaaccaaagggaagtgatgacgaatcttgaaatcgttaattttgcgcttggtttctcgtatacacttaaattcaccttacaactcacttgtattaatctgttaatttaattttttaattaatatttcttaaccaaaaaaaaaaaaaaaaaa

SEQ ID NO: 41 - DNA, 579 bp, Diabrotica virgifera
  misc_feature (1)..(579): RNAi target sequence
ccagagacttcatatcccaaccaagactcacttacaaaactgtatctggtgtcaacggtccactagtaatcctcgaagatgtcaaatttcctaagttcaacgaaattgtccaactcagattatctgacggaagtttaagatcaggtcaagtacttgaagtcagcggttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatattcaaggacaacccatcaacccatggtcccgtatctacccagaggaaatgatccaaactggtatcactgccatcgatgtgatgaactcgattgcccgtggtcagaagattcccattttctcagctgctggtctgccacataacgatattgctgcccaaatttgtaggcaagccggtcttgtcaaaatcccaggcaaatcagttttggatgaccacgaagacaactttg

SEQ ID NO: 42 - DNA, 22 bp, Artificial Sequence
  primer
  misc_feature (1)..(22): forward primer
ccagagacttcatatcccaacc

SEQ ID NO: 43 - DNA, 22 bp, Artificial Sequence
  primer
  misc_feature (1)..(22): reverse primer
caaagttgtcttcgtggtcatc

SEQ ID NO: 44 - DNA, 2471 bp, Diabrotica virgifera
  misc_feature (1)..(2471): WCRW transcript ta00620.009_diavv
tcttaaacttccgtcagataatctgagttgctaattttttactgtctttgatagacgtctcctgtacacgtaaaaatggcttcgacgatatcggcaagacaggctaacagagaacatgttttggccgtatccagagacttcatatcccaaccaagactcacttacaaaactgtatctggtgtcaacggtccactagtaatcctcgaagatgtcaaatttcctaagttcaacgaaattgtccaactcagattatctgacggaagtttaagatcaggtcaagtacttgaagtcagcggttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatattcaaggacaacccatcaacccatggtcccgtatctacccagaggaaatgatccaaactggtatcactgccatcgatgtgatgaactcgattgcccgtggtcagaagattcccattttctcagctgctggtctgccacataacgatattgctgcccaaatttgtaggcaagccggtcttgtcaaaatcccaggcaaatcagttttggatgaccacgaagacaactttgccatcgtgttcgctgctatgggtgttaacatggagactgctagattcttcaaacaagatttcgaagaaaatggttctatggaaaacgtatgtttgttcttgaacttggctaacgatccaaccatcgaaagaatcatcaccccacgtcttgctctaacagccgctgaattcttggcttaccagtgcgaaaaacacgtgttagtcattttaactgacatgtcttcatacgctgaagctttgcgtgaggtatctgccgccagagaggaagtacccggtcgtcgtggtttccccggttacatgtacaccgatttggccaccatctacgaacgtgccggtcgtgtcgaaggccgtaacggttccatcactcaaatccccatcttgactatgcctaacgacgatattactcaccctattcccgatttgacaggttatattaccgaaggacagatctacgtcgaccgtcaattgcacaacaggcagatctacccaccaattaacgtactgccatctctctcacgtttgatgaagtctgctatcggcgaaggtatgaccaggaaggaccactctgacgtttctaaccagttgtatgcttgctatgctatcggtaaggacgtccaggccatgaaagccgtagtaggtgaagaagctctaacacccgacgatcttctctacctcgagttcctaacgaaattcgaaaagaacttcatcacccaaggaaactacgaaaaccgcaccgtcttcgagtctttggacatcggctggcaactactccgtatcttccctaaggaaatgttgaaacgtatccctgcaagcacattggcggaattctatccaagagactctcgtcactagttggtttatgtataaaatttatatatatttaggaagtttgttaggtttgttacaaatatgtccacttattgtatcgattattttcaattgagagatattttaccaaaacaatttgagccgatgagattctacggtgtaatttttgtaaatacttaaagagcgtgtttcaaaaatgcgcttaatataatatattatcaatacagagcaacctttttttctttattgtttttttcactccaaagttcttgaactcctaaaaggagcatagagcttcagtgaaaaggcgccatcccctcattccaagactttccttgacctcttaccaattgttggaaaaattataactcagattaattttattaggtgacagttccataagtaaaaatatgcaatggctatatattgcgtactaaacttaagaagaaaaattgtgtcgctctggaagaaagattacttgcataagaatgaaaatcagtgtcatattttgcgtttatgacatccctagacgatactattttttcgttactatattttttttaaagagatcaagagcaacaatttggagactgatattcttatgcgagttgttttcctactttgtcctattttgaagagtctacaattatttacttaccatttgattaaattagatgaacataagacaatactatatttttatcatgtaagttgatattccctatgtaaattattggcacaatgtaacctccaacttgatttatacatttattttacttttgtttgtctattttttctgtaatagagtggaagaattaacattccattaaatgtcattgcccaatgtataaagcaatatacctcttaccattcgatgctttttcagtattttaattctagatggtgaacggagatttttcttgatgtaggttttg

SEQ ID NO: 45 - DNA, 670 bp, Diabrotica virgifera
  misc_feature (1)..(670): RNAi target sequence
tcgtaatttttggttgtgcttgagaaaatcgtcaaacatccaaaatggtgaacttcaccgtagatgaaattagggccatgatggacaaaaagaggaacatccgtaacatgtccgtcattgcccatgtggaccatggtaaatctacattaacagattctctagtatcaaaagctggtattattgctggtgccaaagctggagaaaccagattcacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgttgaaaacgtcaacgtcattattgccacctacaacgatgattcaggtccaatgggtgaagtcagagttga

SEQ ID NO: 46 - DNA, 22 bp, Artificial Sequence
  primer
  misc_feature (1)..(22): forward primer
tcgtaatttttggttgtgcttg

SEQ ID NO: 47 - DNA, 22 bp, Artificial Sequence
  primer
  misc_feature (1)..(22): reverse primer
tcaactctgacttcacccattg

SEQ ID NO: 48 - DNA, 4535 bp, Diabrotica virgifera
  misc_feature (1)..(4535): WCRW transcript ta02030.005_diavv
ggggggcagagagtcggtctctttctttcacgggagtgcgccatcgttggcgtatcgtaatttttggttgtgcttgagaaaatcgtcaaacatccaaaatggtgaacttcaccgtagatgaaattagggccatgatggacaaaaagaggaacatccgtaacatgtccgtcattgcccatgtggaccatggtaaatctacattaacagattctctagtatcaaaagctggtattattgctggtgccaaagctggagaaaccagattcacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgttgaaaacgtcaacgtcattattgccacctacaacgatgattcaggtccaatgggtgaagtcagagttgaccccagcaaaggttcagttggttttggatcaggtctccacggatgggctttcactctcaaacaattctctgaaatgtatgccgagaaattcaagattgatgtagttaaactaatgaaccgtttgtggggtgagaacttcttcaaccccaaaaccaagaaatggtccaaacaaaaggatgatgataacaaacgttcattctgtatgtacatcttagatccaatctacaagatttttgactccatcatgaactacaagaaagaagaatatgaagcactccttccaaaattgggtattgccttaaaacatgaagataaagacaaagatggtaaacaattattgaaagtagttatgcgtacctggttgccagctggagaagctttacttcagatgatagccattcacttaccatcacctgtggtagcacagaaatacagaatggaaatgttgtacgaaggacctcatgatgatgaagcagctgttggtatcaagaactgtgatccaaatgcacctcttatgatgtatgtatctaaaatggtacccacttctgacaaaggtcgtttctatgcttttggtcgtgtattctctggtaaagtagctactggtatgaaagcccgtatcatgggacccaactacacccctggcaaaaaggaagatttatatgaaaaggctatccaacgtaccattctcatgatgggtcgttatgttgaagctattgaagatgtcccatctggtaacatctgtggtttggttggtgttgatcaattcttggttaagactggtaccattaccactttcaaggatgcccacaacttgaaggtcatgaaattcagtgtatctcctgtagtacgtgttgctgttgaacctaagaaccctgctgatttgccaaaacttgtagaaggtttgaaacgtttgaccaaatccgatcctatggtccaatgtatcattgaagaatctggtgagcacatcattgctggtgccggagaattgcatcttgaaatttgccttaaggatcttgaagaagatcatgcctgcattcccattaagaaatctgaccctgttgtatcctaccgtgagacagtaagtgaagagtctgatcagatgtgcctctcaaaatcacccaacaaacacaacagattgttcatgaaagcttgtcctatgcctgatggacttgctgaagatattgatgatggtaaagttaacccacgtgatgacttcaaagtccgtgcccgttatcttactgagaaatatgactatgatataactgaagcccgtaagatctggtgctttggacctgatggtactggacccaacatccttgttgattgtactaagggagtgcaatatcttaatgaaatcaaagactctgtggtagctggtttccaatgggcaaccaaagaaggtgtcttgtctgaagaaaacttgagaggtgttagattcaacatttatgatgttaccttacacgctgatgctatccatcgtggaggtggtcaaatcattccaacaacccgtaggtgtttgtatgcttgtttaatgacagctgcacccagacttatggaacctatctacaagtgtgaaattatgtgtcctgaagttgctgttggtggtatttatggtgtattgaacagaagacgtggtcacgtatttgaagaagctcaaatcgctggtacacctatgttcttagtaaaagcttacttacctgtaaacgaatcattcggtttcactgctgatttacgttccaacactggaggtcaggccttcccacaatcagtcttcgatcactggcaaatcttacctggtgacccaatggaacccagtaccaaaccctatggaattgtgcaggacacacgtaaaagaaagggtcttaaagaaggacttccagacctggcacaatatctggataaattataaacaactaagaaacttaatttatgtacagattatttaataaaattatttcaatttactcaacggtttttatagttaattgtatttttgatatttttattctgataagttttcagttctctcaaattgatggcaacactagaaatgaaataaactaaataatctgactaatattttatgtttgttatatatatttttgttaacagtccagatatttgtatatttattaatttgacatcaaaagtaaatctgatgaaacatttttgagtatttatttgtggatacaaattcgtcttgttttatttttactcccttgaaacattttattagtgtaatttttatttgagcagtactgattaatgttaagtatattttttggatatgtgtataataaaactcagttttgtaaggaatctagttttctttaatgtgggtatccaaatcaattacgttaagtaaataaaatactatacccaaagttatacaaggttagagagtaaacaataaaacattaaatattctgtacatacattctagactcggataagatgaccgctgaaaataaatgggccctcttgtactactatatctggtacatagtgttactacagaactagaggattttttaaaattgaaggagctaataccacatcagaaaaacacccacatgctttataaaacattaggaaggaaagagtcattacgtataaaaattggagcatactttacagtaaatgaaacaaagaaaccttatctaaacaaatattcacaaagtcctggataaattcattaagatcaatcacattcaatataacagaatttcttcattgttttgaactctttgtagatatctcttggaaacattaatatgctgattggaattctttaattattttatgaaaatattatggttgatttatggcacctgactgatttcagatctccaaatacacattaggaaatcatgatgaagaaaccatttttatttttccatgtagcaaattttctatagaaatattagcttgctaatatccactaactagtagaagtttgtaatgtcacatttatttaaagaaatggcaggatagcaaggattttattttctttaaaaatgataaattgcatacctttgaagaagacaaaatattactcctatacatttcatacaaacaataaaaagaagaaaccacgataccagatgaggaaaaacatggaattcagttcatttagaattgattgttttgaaaagcttaaactaattgatttttgcaagttgacagctgacaaggaatgctcctatacaaactgaaagatcgacgattaggatattttttaaaggttttgtaatgagtaacatattcctaggagtatatcttgagacataatgtgaaagatctaaaatatcctatggggcagattcctgttgtatttaaaaaaagggctgcaaattaatagccactaaagctgactttgctgtttttgaaacaaaaagtctgcgaattaataaccactgaggctgactttgctgttttttaaagaaaaggttgttaattaataaccggtgagactaaccctgatgtttttgaaagaaaggggttgctaattcataatccatggcgcaaactctactgtttttgaaataagagatttttgagaaattgtactgaaaatgtgcctgttcgtattaatatgaactgaaaacaacaaaggcaaatcagggatctaacctaccgatctttaaaaggctgttcccaaaaataaatgattctgatggtttcatggacttaagagtgaaatcaagagaaggtgtctgttcaatatagaaagttttggggatgaaattctttctctctggaatagtttctgttattcaaggtgttaaactaagaatatttcaggataaaa

SEQ ID NO: 49 - DNA, 528 bp, Diabrotica virgifera
  misc_feature (1)..(528): RNAi target sequence
  misc_feature (499)..(499): n can be any nucleotide
  misc_feature (500)..(500): n can be any nucleotide
cgtcaaaagtatttgtcgcatcaactgaagacatgagaaaataattttttacaacataatattttcagatattaaatcaagatggtactagcagatttaggtcgtaaaattacgaccgccttgcagtctttaagcaaggcaacaattattaatgaagaggtcttaaatggaatgctaaatgatatttgtcgggcactcattgaggctgatgttaatatcaaattagttaaatctctcagggaaaatgttaaatctgttattgactttgatgaaatggctggtggtctcaacaagaggaggatgatccaaagtgcagtatttaaagagcttgtcaaattggtagacccaggagtaaagccatatcaacctgttaaaggcaaaccaaatgttattatgtttgttggtttacaaggttctggtaaaacaaccacttgtaccaaactagcttatcattatcagaaaaagaactggaaatcatgtttggtatgtgcagatacanncagagctggtgcctatgatcaggtaaaa

SEQ ID NO: 50 - DNA, 22 bp, Artificial Sequence
  primer
  misc_feature (1)..(22): forward primer
cgtcaaaagtatttgtcgcatc

SEQ ID NO: 51 - DNA, 22 bp, Artificial Sequence
  primer
  misc_feature (1)..(22): reverse primer
ttttacctgatcataggcacca

SEQ ID NO: 52 - DNA, 1927 bp, Diabrotica virgifera
  misc_feature (1)..(1927): WCRW transcript ta05283.001_diavv
ggggggtcgcatcaactgaagacatgagaaaataattttttacaacataatattttcagatattaaatcaagatggtactagcagatttaggtcgtaaaattacgaccgccttgcagtctttaagcaaggcaacaattattaatgaagaggtcttaaatggaatgctaaatgatatttgtcgggcactcattgaggctgatgttaatatcaaattagttaaatctctcagggaaaatgttaaatctgttattgactttgatgaaatggctggtggtctcaacaagaggaggatgatccaaagtgcagtatttaaagagcttgtcaaattggtagacccaggagtaaagccatatcaacctgttaaaggcaaaccaaatgttattatgtttgttggtttacaaggttctggtaaaacaaccacttgtaccaaactagcttatcattatcagaaaaagaactggaaatcatgtttggtatgtgcagatacattcagagctggtgcctacgatcaggtaaaacagaactgtacaaaagctaggatacccttttatggaagttacacagaagttgatcctgtagtcatagcccaggatggtgttgatatgtttaaaaaggaaggttttgaaattataatagtagatacaagtggtagacacaagcaagaagaatctttgtttgaagaaatgttggcagtttctaatgctgtgagaccagacaatattattttcgttatggacgccacaattggtcaagcctgcgaagcccaagcaaaagcctttaaagaaaaagtagatgtaggatccgtaattatcacaaaattggatggtcatgcaaaaggaggtggtgcacttagtgccgttgcagctactaacagtccagttatatttatcggtacaggagagcacatagacgatttagatccatttaaaacaaaacctttcattagtaaattattggggatgggtgacatagaaggtttaattgacaaagtaaacgaattaaagttagaagataatgaagaattgttagaaaaaattaaacatggtcaatttacgctcagagatatgtatgaacaatttcaaaatataatgaagatgggacctttttcacaaattatgggtatgatcccaggatttagccaagattttatgtcaaaaggaagcgaacaggaatcaatggcacgattaaaaagattaatgacaataatggacagtatgaatgattacgagttggacaacagggatggcgcaaaattgtttactaaacaagttggtagagtggtcagggtcgcacaaggatctggtgtaacagaaagagaagtaaaagatctcattacgcagtacacaaaattcgcagcggtggtaaagaaaatgggaggcatcaaaggtctcttcaaaggtggcgatatggctaaaaacgtcaaccacaaccagatggcgaaacttaatcaacaaatggccaaaatgatggaccctagagtcctccaacaaatgggcggcatggcaggtttgcaaaatatgatgagacaactccaagcaggcgcagctggtggtttagggggcttaggtaatcttatggggggctttggtaataaatgattgttaaatattttttatgattattttgaattgccatttgatacttctttcagaagccatatgttgtgtcaagcaacattttttatttgtagaataatctaataattaacgcagactttatcattaccgaagcaaactgctacaatatgtataaagaaagttaatggcatttgaaagaattattgagtgatttgtttctaaatggatgaggaagcagagtatttttgttttgttttgaatgtgtagaaaatattttatattgacattgtaaaaacggtacactgtttgtaacttattcctaaaaataaacagttttctaataaaaaaa

SEQ ID NO: 53 - DNA, 605 bp, Diabrotica virgifera
  misc_feature (1)..(605): RNAi target sequence
aggctgtaagagaacctatgcagtctggaattaaggctgtagattctcttgtaccaattggtcgtggtcagcgtgagttgatcattggtgatcgtcaaactggtaaaactgctttggctattgatacaatcatcaaccaaaaacgattcaacgatgctgaagacgaaaagaagaaattgtactgcatttacgtcgccatcggtcaaaagagatctactgtggctcaaatcttgaagcgtctcacagacactggtgccatcaactacacaatcattgtatcagctactgcatctgatgctgcacctttgcaatacctcgccccatactccggatgtgctatgggtgaatttttcagagataatggcaaacatgccctcatcatctatgatgatttgtccaaacaagccgtagcctaccgtcagatgtctctgttgcttcgtcgtcctccagggcgtgaagcctaccctggtgatgtattctaccttcactcccgtcttttggaacgtgccgccaagatgtctgaagcccacggtggtggttcattgactgccttgcccgtaattgaaacccaagctggtgatgtatcagcctacattccaaccaat

SEQ ID NO: 54 - DNA, 23 bp, Artificial Sequence
  primer
  misc_feature (1)..(23): forward primer
aggctgtaagagaacctatgcag

SEQ ID NO: 55 - DNA, 22 bp, Artificial Sequence
  primer
  misc_feature (1)..(22): reverse primer
attggttggaatgtaggctgat

SEQ ID NO: 56 - DNA, 2003 bp, Diabrotica virgifera
  misc_feature (1)..(2003): WCRW transcript ta00263.005_diavv
ggggggatcgtgcgcagttcggcctattcgggtactcgttcagtgttcgtcacttaattttcagtactggggcgactggcaaaaaaatgtctttgctttccgcacgattagctgcctcattggcaagaaatgcccctaaaaatgtaacacagattgcgggagctgtcttccctgctgcatccgtcgcagcccggaacttccatgctactccacaaaacaaaggtgctgaaatttcatccatccttgaagagcgcatccttggtgctgcaccaaaagccaacctcgatgaaacaggacgagtcttaagtattggtgacggtatcgcccgtgtatatgggttgaacaacatccaagccgatgagatggtggaattctcctccggtctcaaaggtatggcccttaacttggaacctgacaacgttggtgttgtagtatttggtaacgacaaactcattaaggaaggtgacattgtcaagagaactggtgccattgtagatgtgcctgtaggtgaccaaattttgggacgtgtagttgatgccttaggtaacccaattgatggcaaaggaccattgaacaccaaacaacgtttccgtgtaggtatcaaagcccctggtatcattccacgtatctctgtaagagaacctatgcagtctggaattaaggctgtagattctcttgtaccaattggtcgtggtcagcgtgagttgatcattggtgatcgtcaaactggtaaaactgctttggctattgatacaatcatcaaccaaaaacgattcaacgatgctgaagacgaaaagaagaaattgtactgcatttacgtcgccatcggtcaaaagagatctactgtggctcaaatcttgaagcgtctcacagacactggtgccatcaactacacaatcattgtatcagctactgcatctgatgctgcacctttgcaatacctcgccccatactccggatgtgctatgggtgaatttttcagagataatggcaaacatgccctcatcatctatgatgatttgtccaaacaagccgtagcctaccgtcagatgtctctgttgcttcgtcgtcctccagggcgtgaagcctaccctggtgatgtattctaccttcactcccgtcttttggaacgtgccgccaagatgtctgaagcccacggtggtggttcattgactgccttgcccgtaattgaaacccaagctggtgatgtatcagcctacattccaaccaatgtcatttccatcactgatggacaaatcttcttggaaactgaattgttctacaaaggtatcagacctgccattaacgtaggtttgtctgtatccagagtaggatcagctgctcaaaccaaggccatgaaacaggttgctggttccatgaaactggaattggcccaataccgtgaagtagctgcttttgcccaattcggttccgatcttgatgctgctactcagcaattgttgaacagaggtgtacgtcttactgaattgttgaaacaaggtcaatacgtacccatggctattgaagaacaagtagccatcatctactgtggtgtcagaggacatttggacaaagttgatccatcaaagattacagtatttgaaaaacaattctcagaacacattaagactagccacaaaaacatcttgcagagcattgccaaggaaggaaaaatcacagacgatactgatgcccaactcaagaaagtcgttcaagatttcttggccagcttctctggttaaatataaataatacaattattattaatacctaaatcgtcacttttgttgatgtgatctgtaaacgtttaagaacttcatgagctgtaatcctttcaaattagaataattaggcaggactcctatgttatccaataaggcacgtgaaagaattttcttttctccattttacaatatttatcgatcattgttttttaaggatatcttatttgtaaaaataaaaaataaactttatattttttaaaaaaaaaaaaaaaaaatcgg

SEQ ID NO: 57 - DNA, 583 bp, Diabrotica virgifera
  misc_feature (1)..(583): RNAi target sequence
gcacgaggctttattagacagaggtattcatcccataaggattgctgatggtttcgagctagcttgtcaaacagctgtagctcatttggaaaaaattgcagaactatttccggtatcagcagaaaacactgaaccattaataaaagttgcaatgaccactctgggatctaaaatcattaacaagtgtcataaacagatggcagaaatagctgttaatgcagtcttagctgttgcagatttagaacagaaagatgttaattttgaacttattaaagttgaaggcaaggttggtggaaaattggaagacacaacattagttaaaggtgtagttattgacaaaacaatgtcccatccacaaatgcccaaagaactaaaagatgtaaaattggctattctcacctgcccgttcgaaccaccaaaaccaaagaccaaacataagttggatgtcagcagtgtggaagattataaggaactaagacagtatgaacaagaaaagttcaaagaaatcgttggtttggtaaagaaagctggagctacattagcaatttgtcaatggggcttcgatgatgaagccaatcactta

SEQ ID NO: 58 - DNA, 23 bp, Artificial Sequence
  primer
  misc_feature (1)..(23): forward primer
gcacgaggctttattagacagag

SEQ ID NO: 59 - DNA, 22 bp, Artificial Sequence
  primer
  misc_feature (1)..(22): reverse primer
taagtgattggcttcatcatcg

SEQ ID NO: 60 - DNA, 1889 bp, Diabrotica virgifera
  misc_feature (1)..(1889): WCRW transcript ta05506.001_diavv
aaaaatatcaaatgtcagttttctgtcactttcatgggagtagccagttcgaaacaaaaataaaattttaattaatctggaacatctcccaattttttagaaaacttacattttcaatatgagtgctataccaggaagtattgcatttgatgaatatggacgacccttcataattcttagagaccaagataagcaaaagaggttgaccgggatagatgcacttaagtcacatattttggcagcgagacaaatcgctcaaactataagcacttctttgggtcccaaaggtttagacaagatgatggtgtcacctgacggtgaagtaacagtcactaatgatggtgctactattttgaaaatgatggatgttgaacatgaagtcgctaaattgctagtacagctatcacagtcccaagatgatgaaattggtgatggtaccacaggtgttgtagttttggctggtgccctgttagagcaagcaggatctttattagacagaggtattcatcccataaggattgctgatggttttgagctagcttgtcaaacagctgtagctcatttggaaaaaattgcagaactatttccagtatcagcagaaaacactgaaccattaataaaagttgcaatgaccactctgggatctaaaatcattaacaagtgtcataaacagatggcagaaatagctgttaatgcagtcttagctgttgcagatttagaacagaaagatgttaattttgaacttattaaagttgaaggcaaggttggtggaaaattggaagacacaacattagttaaaggtgtagttattgacaaaacaatgtcccatccacaaatgcccaaagaactaaaagatgtaaaattggctattctcacctgcccgttcgaaccaccaaaaccaaagaccaaacataagttggatgtcagcagtgtggaagattataaggaactaagacagtatgaacaagaaaagttcaaagaaatcgttggtttggtaaagaaagctggagctacattagcaatttgtcaatggggcttcgatgatgaagccaatcacttattgttacaacaagaattaccagctgtaagatgggttggaggtccagaaattgaacttatagcaatagctactgggggtaggatagttccccgttttgaagagcttactcctgaaaaacttggtcatgctggtttggtacgagaaattgcatttggcaccactaaggatagaatgttggttattgaagaatgttcaaattcacgggcagttacgattcttgtcagaggaggtaatcaaatgttagtagctgaagccaagagaagtctccatgatgcattatgtgttgtcaggagtttagttcaagaaccaagagtagtgtatggtggtggagcagcagaaattgcctgctgtttggcagtcgcggctcaagcagatcaactagcttccttggaacagtacgcctatcgtgcatttgctgaagccttagaaagtataccacttgctttggctgataacagtgggctatctgcgatccatacgctaggagaagtcaaggctaaacaagcagctacaggagatccagctctcggtatcgattgtatgaatactggaaacctcaacatgagagaacaacatgttatcgaatcactcagatcaaaaagacaacaatttttgttggccacccagttggttaaaatgatattgaaaattgacgatgtacgccaacctgcatcgggataaaatgacacttatttttgtactaccggcgttaatttctaattctcactaataatgacttttataagttgatctgcgtaatgcttctttgttcttataatcactgaaagtattaatataatttatagaaaaaaaaaaaaaaaaaatgcga

SEQ ID NO: 61 - DNA, 588 bp, Diabrotica virgifera
  misc_feature (1)..(588): RNAi target sequence
agagaacagtcagcacaagcagttattgatatcgatgatttagataatttggctacacctgaaagtatattgttgagtgctgtttctggagaagatgcccaagaccgttcagatcgtacaattcttactccgtgggttaagttcctttgggaatcttactgtcaatgtttggaacttttgcgtactaatgcacatgttgagaacttatatcatgatatagccaggatggctttccagttttgtttgaaatataatagaaaaacagaatttagaaaattatgtgataaattgaggaaacatttagaggatatctgcaaattaccaacacaaatggcaaatgtttctatgtctaaaccagaaacccaacaacttaatcttgaaacgaggctccatcaactagattttgctattcagatggagttatggcaagaagcctacaaggccatcgaagacatccataacttgatgaatttgtccaagaagagtccagtaccaaaaaccatggcaaactattaccagaaactagccatggtgttctggaaagctggtaattatctattccatgctgctgctttgttcaagttcttc

SEQ ID NO: 62 - DNA, 22 bp, Artificial Sequence
  primer
  misc_feature (1)..(22): forward primer
agagaacagtcagcacaagcag

SEQ ID NO: 63 - DNA, 22 bp, Artificial Sequence
  primer
  misc_feature (1)..(22): reverse primer
gaagaacttgaacaaagcagca

SEQ ID NO: 64 - DNA, 3733 bp, Diabrotica virgifera
  misc_feature (1)..(3733): WCRW transcript ta05000.002_diavv
attttgtctttcaactgacgtttgctttgacgaaatttcagaagataatagttttatttactattctatatatttaaatgtgaagtgaatacaacaaataaacacagtaaagatggcccgatacggtcagcgtccggaaaacgctttaaagcgagcgaatgaattcatcgaagttggaaaaccagctagagcccttgatactctccaagaagtttttcgtaataaaaaatgggcgtacaattggtcagaatccgttttggaacctattatgttcaaatatctggatctatgtgtagaactgaaaaaatctcacattgccaaggaaggtcttttccaatacaggaacatgttccagtcagtgaatgtaggatcacttgaaaatgttataagagggtatttgcggatggcagaagaaagaacagagaatgctagagaacagtcagcacaagcagttattgatatcgatgatttagataatttggctacacctgaaagtatattgttgagtgctgtttctggagaagatgcccaagaccgttcagatcgtacaattcttactccgtgggttaagttcctttgggaatcttactgtcaatgtttggaacttttgcgtacaaatgcacatgttgagaacttgtatcatgatatagccaggatggctttccagttttgtttgaaatataatagaaaaacagaatttagaaaattatgtgataaattgaggaaacatttagaggatatctgcaaattaccaacacaaatggcaaatgtttctatgtctaaaccagaaacccaacaacttaatcttgaaacgaggctccatcaactagattttgctattcagatggagttatggcaagaagcctacaaggccatcgaagacatccataacttgatgaatttgtccaagaagagtccagtaccaaaaaccatggcaaactattaccagaaactagccatggtgttctggaaagctggtaattatctattccatgctgctgctttgttcaagttcttccagttgtcaaaggagatgaagaagaacatcactccagaggaattacaaagaatggcctgtagggtattaatcgctacactagcaataccgttgccttccgctcaccctgagtttgatagattcattgaaaccgacaagtcacctttagagaaggctcagcgtttagctgttttattggggctgattcaaccacctactagagctagtcttttgagagatcttgtaagagttaatgttgtgaacctggcaagtccacaactacaagatttgtacaattggctggaagtggagttccatcctttactattgtgtcagagagtgcatgaggtaatcaaatctctcgaatctgaagaaaatgcagccctccaacaatatgtgccagctttacaagatgtaactctggtgcgtctagtgagacagatagcacaagtctatcagaccatagaatttgctaggttgatccagattgccaaatttactacaccttttcatctggagagacttttggttgattgtgtgagacacaatgatatgcaaattcgtattgatcatggcaaagactgtatccactttggaatggacctgagtgaaagccaaagagaggacaaaccagagggacccactttgcaagttatgcctagtgagcaagtcagaaatcaacttattaacatgtctactgtattgaatcaagccatacaagtcattaatcctaataagaagaagcttgaacgcgaaaaacttagagctgttatggttcagaattatcacgaaacaaaggttagagaacaccagaaaattttacaaaggcacaagattattgaggacagaaaggaatatattgagcgtttgaatacagtcagggaagaagaggagcagaaaagattggaagaaatgcaacggcagcacttactggccgaacaaaaacgattggaccaagaaagagaagaaagagagcggaaacgtgctctaaatgaaatccagcaggttaaagacagacacttaaaggaaaaactacaacaaatcagacagactggtcatggtcagaagattctgaagaaaatggatgaagacgatatcaaaaagcttgatgcagaccaaatagcggtgaaagaagcagaagagctacaaaaggaacgtcgcgaacttcaagccaagcttaaatctcaagaaaagaaggtagactatttcgagcgtgccaagcggttggaagaaatccctctacttcaagccaatatgcaagaacgtcaattacaggatcagaacttctgggagcaacaggagaaagagcgaatcgctgcagcaattgaagagcgcaagctggccgtcgcaacgagagaccgtttgctacgcatgaaagtcgacaaagatgaattcatctcgaaattaaagaaggagagaaacattgtctacgaagacaatcttaaggaattcgagaagatgttgagcgaggaaagaaagaagaggcttttggaaagaaagatccaaagaaaagaggagcgccgtgctacatatattaaagagaaggaagaagaagccgaacgtagagccaacgaaaagagacgtcgcgaagaagaagaaagggagagattagaggaaatagcgagaaaagaacaggagcaacaagaacgcgcactaaaggaggaacaagaaaggaagaagaaggaacatcaagagagtttggatagagcttggacaatgcagaaagctaaagaggaagaaatcgaaaagaaattagcaatggagaaagaaagcagcgacaaaggaaaagattcttggaggaaagaccccaagaatagctcttcttggaggagggacgagaaacctgctgacgaacccaaaaatgaaccttggagagcatctcgtttccgatcaaatgctgaagaacccccaaaaggcgacaacaccactacttcttcttggaggaatgacgataaaagggaagatcgcagagacgatcgccaaggtgaacgtcgcggcggagacggcggaagatttggcaaccgcgacagcggaagatttggcgacagagacagagaaggtggtgtcagattcacgagagataatcgggataatcgtggggatcgcagggacgatagggagaggagagacgacagggataacagggataggagagacgacagagatcgtagagatgatagggataggagagacgacagggagcgtagagatgatagagagagaagagatgaccgtggcggaagagatgataaccgggaccgccgagacgatcgtgatcgtagagacgacagggaccgaagaggcggggacgaaggtacttggcgtagaaagactgacgatgaccgtcgttctactcctatgagaagagaagctgctccagaatcagcatggaggagtgctaaccgagagaccgatcgtagagatgattctaagagagacgatagaaggggaactccgatgaccagagaaaaaccagcagctcgcgagcagcaatctcagccagaaggcgaggagggctggtcccaagttggaaggagacgttaagccattatataatctagactagagaattaagttacacaattataccgatattttatttacctacaggttacgagggttttcatttatagtaatcattgttttaatgcggaactggcttgaactcgttgataaggcagtgctgtgtgctaattaacccatatagttaataaaatttcagatattataaaaaaa

SEQ ID NO: 65 - DNA, 716 bp, Diabrotica virgifera
  misc_feature (1)..(716): RNAi target sequence
ttgaaaaagatagggctccaaagtcctattgccaacaaaaaaacaacgcaagacattaaacaacttttttcaagcccatctgtatttaaaaaaacagtgcaaaatgtttctgtgggactggtttacgggaatgctgggatatctaggattgtggaagaaacctggaaaactattattcttaggactggataacgcaggcaaaactacccttctacatatgctcaaggatgacagactggcccagcatcttcccacgttacatcccacatcagaggagctttccattggtaacatgaggtttacgacgttcgatttggggggccacgagcaggctaggagagtgtggagggactactttccagcagtcgatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaatgatctacccggtaggcctctagaactatttatgtgctctatactcaaaagacaaggttatggagaaggtttccgttggttggcacaatatatcgattaattatgtatttttccatttcgttctgtcattg

SEQ ID NO: 66 - DNA, 22 bp, Artificial Sequence
  primer
  misc_feature (1)..(22): forward primer
ttgaaaaagatagggctccaaa

SEQ ID NO: 67 - DNA, 22 bp, Artificial Sequence
  primer
  misc_feature (1)..(22): reverse primer
caatgacagaacgaaatggaaa

SEQ ID NO: 68 - DNA, 2438 bp, Diabrotica virgifera
  misc_feature (1)..(2438): WCRW transcript ta00303.001_diavv
ggggggaaaaagatagggctccaaagtcctattgccaacaaaaaaacaacgcaagacattaaacaacttttttcaagcccatctgtatttaaaaaaacagtgcaaaatgtttctgtgggactggtttacgggaatgctgggatatctaggattgtggaagaaatctggaaaactattattcttaggactggataacgcaggcaaaactacccttctacatatgctcaaggatgacagactggcccagcatcttcccacgttacatcccacatcagaggagctttccattggtaacatgaggtttacgacgttcgatttggggggccacgagcaggctaggagagtgtggagggactactttccagcagtcgatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaatgatctacccggtaggcctctagaactatttatgtgctctatactcaaaagacaaggttatggagaaggtttccgttggttggcacaatatatcgattaattatgtatttttccatttcgttctgtcattgagttaggatattaatgtttgaggaactattggcaacactgcaactacctgattcatttcagatcttaggtactttacataaatatctaaatatagatgttggcaatgtaattttgaacaacagtatatacattcaatgtaaattatatatttttagttaagttaccttcttaaatggtgtttgagtggctatggtactgaaatagtttgactttttgtgttcttcgataactaaaaatgatttcttgtggaaagttacactcagaattacatagttaacttctttatcagcagttgttgtcaagatttccattttgagacgattgttttgtaaattaggtgggaatttttaaaatgttggactgttttttaacatgcctttctcaacttttgttacaaataatgttttgtccagttgtaaatgttttatttaactagagactttctaggttgtgttaataatagtcattggtcaaatacgatagaagccaaaatttgaagaaaaggaacaatgtactagggtggtccgataagtattttgccttcaaaagaaaagtggcgatttatttttcaatattgtctccttctagctcaatacacgtgacccagcgaggcttcacccagattcagcggcttcaatttctgaaggtctgtaaagtagacatcaatagcagcgatgaactcactaaatcgacttacatttctgcccgacgagtgacttttcaaatttggaaacgaaaagaaatcgcacagggccaaatctggagaatacagtggatgggatagtagttagtagtccgaatcgaaaaatttggccatggcgacggcgaaggtgtgagcgggtgcgttgtcgtggaagagtactttttatcttccccaattggggctgttttttctgcaagtcggtgtcgaatcgacccaataattcgccaaagtaaagccctgtgaccgttttgccctttttttcaggaagctgatatatatcacactttgtgaatcccagaaaacggtggtcatcacttttcggtcgttaggacagtctttgccttcttcggagtatgttcgcggggcgacgtccactgtatcaactgttccttggtttctggtgagtactggtggatccaagtttcatcgatgattatgaaacaatgtataaacaataggaaggtttaatttatttctaattctgagtaggaatggtcacttaaaggttttgtaatttaacttaagtacctaatgaatttattttggactttttcaagcttggctatatggacttcataagcgggtgaccaaacaactgagcaatactcaagaacagatctaactagggaaatgtaaatcagtctgattgaattaatgttatgcaaacatctagaagttctaataatgaagcctaacatgtgaaatgccgcaccaaccacatcaacacaatgcgcataaacaaaataatgaagaatataactcaaaaaacagatacagcacaggtgacacaacacacagcagtcaagcacaaagtgaaagcacaaaaaactacaaaaccaaaaaacaagaacaaaatcacaggcaaatatcaaacgaagtgaattattcaacaaaccaaaaataaaccaaatgccacacccagtcaaaacaaaacaacgaaggttgagattttgacatagataggccatctacaagaatgtattacatatacagggtgcgccaagcctctggtttt

SEQ ID NO: 69 - DNA, 619 bp, Diabrotica virgifera
  misc_feature (1)..(619): RNAi target sequence
tcggtcgatttaggtagtaggtgtaataaattttgaaagtgataaagacagtttgtgataaactgtagtgcagttcttttcgtttattttctcacctctcacataacaattaaactgaaacaatggcccccccgggtatcgggaattcggtggagatccgccccgaggcgacagcatcgtcggcagagaggagcagtagcaacggagtcgctacattccaaaaggacatcgtcgttttggatgggggcttcgctactcaattaggctgccacgtccaacaaccgattgatggagacgtcctatggagttccaggttcttggccaccaatccagaggctgttattgatactcacttagattttctcagagctggtgcggatgtaattattactaacacatatcaagcagatgtcaacttgtttgccaaacatctcaatatgaccaaagaagaaggatacaacttaataaaagactcagtgaagatggccaaaacagctgttgaaagatatttaaaagaatatccggaagcaagaaaacctcttatagctggttcagtgggtccttacggagcttcactacatgatggttcggaatacacaggagcctatgcgaaaactac

SEQ ID NO: 70 - DNA, 23 bp, Artificial Sequence
  primer
  misc_feature (1)..(23): forward primer
tcggtcgatttaggtagtaggtg

SEQ ID NO: 71 - DNA, 22 bp, Artificial Sequence
  primer
  misc_feature (1)..(22): reverse primer
gtagttttcgcataggctcctg

SEQ ID NO: 72 - DNA, 1246 bp, Diabrotica virgifera
  misc_feature (1)..(1246): WCRW transcript ta08045.004_diavv
ggtcactcgtcgccgactgccgacttgatcggtcgatttaggtagtaggtgtaataaattttgaaagtgataaagacagtttgtgataaactgtagtgcagttcttttcgtttattttctcacctctcacataacaattaaactgaaacaatggcccccccgggtatcgggaattcggtggagatccgccccgaggcgacagcatcgtcggcagagaggagcagtagcaacggagtcgctacattccaaaaggacatcgtcgttttggatgggggcttcgctactcaattaggctgccacgtccaacaaccgattgatggagacgtcctatggagttccaggttcttggccaccaatccagaggctgttattgatactcacttagattttctcagagctggtgcggatgtaattattactaacacatatcaagcagatgtcaacttgtttgccaaacatctcaatatgaccaaagaagaaggatacaacttaataaaagactcagtgaagatggccaaaacagctgttgaaagatatttaaaagaatatccggaagcaagaaaacctcttatagctggttcagtgggtccttacggagcttcactacatgatggttcggaatacacaggagcctatgcgaaaactacttcggcagaaaccatgagagaatggcacgggcccagaataaaagccttggtggaaggaggagttgatctcttagcaattgaaactattccgaatgcagttgaagctgagatgttggtccagttaataaaagaagaatatcctaatgttaaagcgtggcttgcttttagtgtagcgcaagacggaaaatcaatagcctacggagaagacttcaaaacaatcgcccgaaaatgttatgactccaatcctgagcaattagtagccataggaatcaactgcacggccccacgactaatcgaaccccttctcaccgggataaatgatgatagaaaagacaacccccgaccacttattgtctaccctaacagcggagaaagttacaatgtcgaactcggggatgattccagatggcataaccgagaaaactgcgagccagtagacacaaatattcacaaatggttagatctgggagtcacgtgggtcggaggctgctgtagaacctacgccgtggatgtcacaagaatacgcgaccaagtgcagttatggaaggagaaacagtagctaaactttgaatttatattttaatttttatttttaataa

SEQ ID NO: 73 - DNA, 680 bp, Diabrotica virgifera
  misc_feature (1)..(680): RNAi target sequence
attgtcaacctggaaaacgacttgtcgaagtcgcatagtttttataagtttaaataaactaaattaaatataaatacttcgagaatgcaataattattattctttaactagacccacagcttattaattagcagaagtagtagcagacttatactaactagcataaggagaaacatattaacatagcatggcagacttcatagattctgaagcagaagaaagtagtgaggaggaggaattagatcatagggatcgtaaaaaagcccaaaaagccaaagttgtagatagttcagatgaagatgatgaagatgatgacgaaagactgagagaggaattaaaggatttgattgatgataatcctattgaagaaagtgatgctgagtctgatgcttcaggaagggaaaaacgtaagaaatctgacgacgaggatttggatgatcgactggaagatgaagattatgatttgcttgaagaaaatttgggtgttaaagttgaaagaaggaaattcaagcgactgcggcgttttgaagatgaagaaagtgaaggagaagaagaacatgatcctgaacaagatagggaacaaattgctatggatatattttcagatgatgacgatgaaagacgatcagaacgaagtcacaggcctgccgtcgaacaagaaacttatggtgtaggcgagg

SEQ ID NO: 74 - DNA, 22 bp, Artificial Sequence
  primer
  misc_feature (1)..(22): forward primer
attgtcaacctggaaaacgact

SEQ ID NO: 75 - DNA, 22 bp, Artificial Sequence
  primer
  misc_feature (1)..(22): reverse primer
cctcgcctacaccataagtttc

SEQ ID NO: 76 - DNA, 6054 bp, Diabrotica virgifera
  misc_feature (1)..(6054): WCRW transcript ta02840.001_diavv
agtttaaataaactaaattaaatataaatacttcgagaatgcaataattattattctttaactagacccacagcttattaattagcagaagtagtagcagacttatactaactagcataaggagaaacatattaacataacatggcagacttcatagattctgaagcagaagaaagtagtgaggaggaggaattagatcatagggatcgtaaaaaagcccaaaaagccaaagttgtagatagttcagatgaagatgatgaagatgatgacgaaagactgagagaggaattaaaggatttgattgatgataatcctattgaagaaagtgatgctgagtctgatgcttcaggaagggaaaaacgtaagaaatctgacgacgaggatttggatgatcgactggaagatgaagattatgatttgcttgaagaaaatttgggtgttaaagttgaaagaaggaaattcaagcgactgcggcgttttgaagatgaagaaagtgaaggagaagaagaacatgatcctgaacaagatagggaacaaattgctatggatatattttcagatgatgacgatgaaagacgatcagaacgaagtcacagacctgccgtcgaacaagaaacttatggtgtaggcgaggaagaagaggaaggggagtactcggatgccgatgattttatagttgacgatgacggtagaccgatagctgaaaaaaaaaaaaaaaaaaaaaaaaaaaaaacagatgccgctctccaagaggctcaagaaaccttcggtgtcgattttgattatgatgaatttagtaaatacgatgaagatgattacgaagatgaagaggaggaggatgacgaatacgaggaagatgatgtagagaaaaggaaacggcctaaaaagacttcaaagaaaaaaccgacgaagaaatccatttttgaagtgtatgaacctagtgaacttaaaagagggttctttaccgatctcgataatgaaatccgaaacactgatattcccgaaagaatgcaacttcgtgatgttccaatcaccgctgttccggatgactcaactgaacttgatgatgaagcagaatggatttacaggcaagcgttttgtaacagaactgtttccaatgtggattctcatttatcatcagaggcaagagagaaattaaagaagactcatcatgccatcggaaaaatcagaaaagcattagattttataagaaatcaacaattagaagtaccgtttattgctttttatagaaaggagtatgttcaaccggaacttaatattaacgatttgtggaaagtatataaatacgatgcaaagtggtgccaattgaaaacacgcaaagaaaacctcttgaagctttttgaaaaaatgaggtcatatcaaactgaccacataatgaaagatccagatgcaccaattccagacaaccttcgtatcatgactgagtccgacattgagcgattgaaaaatgttcaaaccgccgaagagttaaatgacgttcacaatcatttcattttatattatgctgcagatttgccagccatgcatgccgcgtggagagtcaaagaaagagaaaggagaagacaggaaagaaaggaggctagacttaagctcatcgctgaaagtgaagaaggtgctgaaattcctgaagagcctgaggaaattgacgatgatgaaccagaagctgaaaccttaaaatacgccaatagatcaggcagctatgcactatgtaataaaggaggtttgggtcctctagcgaagaaatttggtttaacgcctgaagaatttgccgaaaacctgagagataattatcagaggcacgaagtagatcaagaacatatagaacctgtagaagtcgctaaagaattcgtatcgccgaaatttcctacagtggaagaagtgttgcaagctactaaacacatggtagctttacaaatagcaagagaaccattagtaaggaaatgcgtaagagaaattttctttgaacgagctagattaaacgtttatccaaccaaaaagggtgtgaaagttatagatgaagctcataattgctatagtatgaagtatgtaaaaaataaaccagtaagagatcttgcaggcgaccaatttttaaaattatgtttagccgaagaggagaacctccttactattaccatcaatgaccatattcaaggaaacactactaacaattacattgatgaagtcaaacaattatatataaaggatgaattcagcaaacacgttcaggattggaatgcgctaagaatggaatcggtagaaagggctttaacgaaaagtgtcttaccagatttaagatctgaattaaaacgaacgttgctcacagaggctaaagaattcgtattaaaagcttgctgtagaaaattatataattggataaagattgctccatacgcaataacttttcccgatgaagacgaagatgattgggatacatccaaaggtgttagaactatgggtgtagcatacgtaccagagcacacagtatcagcttttacctgtatttcagcaccagacggagatataactgattatctcagattaccaaatattctaaaaagaaaaaatagctttcgaactgaagaaaaacttatgaaggaagctgatcttcaagcactgaaaaatttcatattccttaaaaagcctcatgtgatagcagtagggggtgagtccagagaagccttaatgatcgctgatgatatcagaggagtaataagtgaactaatagaatccgaccaattcccacagattagggttgaaattattgataatgaattagccaaagtgtacgcaaattccattaaaggttcaactgatttcagagattatccagagttgttaaggcaagctatttcattagctcgaagaatgcaagatcctttggttgaattttcccaattatgtaatagcgatgaggaaattttgagtctgaggtttcatcccttgcaggaacaagtccagaaagaagaactactagaagctctctgtttagaatttgtcaacagaacaaatgaagtaggtgtagatataaatcttgccgttcagcagattcataaaaagtagtttagttcaattcatatgcggtctaggaccgcgtaaaggtcaagcgttacttaaagttctgaaacaaactaatcagaggcttgaaaacagaacccaattggttacattttgtcatatgggtccaaaagtttttattaattgttctggattcataaagattgataccaatagtttaggagacagtactgaggcatatgttgaaatattggatggctctcgagttcatcccgaaacttatgaatgggcacgaaaaatggctgtggatgctttagaatatgacgatgatgagggagctaatccggcgggagctttagaggaaattctcgaggcgccagagaggttaaaagatcttgacttggatgcatttgcggaggaattggaaagacaaggaatttggtaacaagagtataacattgtatgacattagagcagaactgaactcgcgatataaagatttgagacaaccttttcgttctgcaaatcctgaagaactattcgatatgcttactaaagaaactcccgaaacattttatattggaaaaatggttacatctaccgtgtttggcattgcaaggagaaaaccaaagtcagaccagctcgatcaagctaatccggtccgtaatgacgaaactggtttgtggcagtgccccttctgtttgaaaaatgattttcctgaattatctgatgtatggaatcattttgatgcaggagcatgtcctggtcaagctactggagttaaactaagactggataatggtatattaggttatatttatataaaaaatataagcgacaaaccagttgctaatccggaagaaagagtaggcataggacaattaattcactgtagaataataaaaattgacgtagagaagtttagtgttgattgtacatcgaaatctagcgatcttgctgataaaaatcatgaatggagacctcaacgagatcctcattatgatcaagaacgtgaagacaaagacaatcgattagaagccgagaagaagaaagagaaacagcgtatgacgtacatcaagagggttatcgttcatccggcgttccataacatatcctatgccgaagccgaaaaatgtatggttaatatggaccagggtgaagttatcattaggccttcgaggaagggcccggaacaatcgaacataacgaagaaggttaaggaaggaacatatcaacacaaagatactaaagaaaaacgaaaactgaacaatggtacattaggaaaatcattatggattggaaatgaagaatttgaagatcttgatgaaataatagctaggcacgttacaccaatggcggcgcatgctagagatttactgtattttaggtattacaaagatttccaaggtggtcataaagataaggctgaggaatatctaaaagatgaaaaaaagaaaaatgcttctaaaattcattatgtagttagtgctgctaagaatatacctggtaaatttcttctttcgtaccttccacgcaacaaagttagacacgaatatgtaacagttactccagaaggctttcggtttagacaacaaatgtttgattccgtttcttcgttatttaaatggttcaaagaacatttccgggagcctccaccaggcggtgcaacaccaggtagcacgccaaggatggcttcaagcagaactggatatggaagtgccacacccgcgtatagtatgaataatgaagctattcaaagagttgctcaaaatttaccaagtcatgtagttcaagcgttatctgctgccaccaaccaaactccacattatccccacacccctggttatggaggcaattatattaatacgccttacactccaagtggtcaaactccatacatgactccgtacgctacaccccatacgcagcaaactccccgctatggtcatcaaacaccttcccaacacatggcgagctcagcaccacaaggtctcaacaatccctttttacatcctggcgcggtgactccctcccaacgaactcctatttatcgcaaccatcctgcacaatctccagtaatgcttcctacaagccctgtaccaagtccaggttcccagagttcatacagtagtcatttaagtcataatcagcgaagtggaagttatgctgaatccttaagattccaacctcccgaatcgccgagaagctcagtgagtaatagaagctttcaaactgatagatacggcggtgataggtatggtaaaggaggaagtcatagatatggtggaagctcaaacgaagatagatatggtaagggaggaggaggaaatgaaaatacggattggcagaaagctgcagaagcatgggctcgatctagatctactccgagaagtgatggccgtaatactccaagatctgtaggtcaacgaactcctagatacgacaacgacgccgaacgttctagaatgaaacacctcagcaagagcccgaggtctgttaggtctactcctcgaaccaatacatctccacattctatgtccctaggtgatgctacccctctgtatgacgaaagtatctaaattactttgtatttggttatatagtagggtaacagtgatattgtaaatgctaaaatcaacaatacagattcgcgatattaagtcacaatgacgacctctcgtgtatttcggctgaactagcatcgaggggtcttttcaatgtcaaacgctgagcgcacatgcatttgaaacaagtaggcaatattcacttatttatttttacatgttttaaattaattattgggtaatataaaatgattaacatggaatcttcacgtttcaataaaagttggcgtcgatattgtatataaaattaaaaaaaatatgtaaaaataaataatattacctacttgtctcaaatgcacgtgcgcccagcgtttgacattgaaatcaccctcaaagctagttcagacgaaatagacgagaggtcgtcgttgtgacttaacatcgtgaatagaaa

SEQ ID NO: 77 - DNA, 319 bp, Diabrotica virgifera
  misc_feature (1)..(319): RNAi target sequence
tggtaagggaggcaaagttaagggaaaagcaaagtcccgatcaaatcgtgctggtttacaatttcctgtaggtcgtattcatcgtttattgagaaaaggaaattatgccgaaagagttggtgctggagctcctgtatacttggcagctgttatggaatatttagctgctgaagttttggaattggcaggaaatgcagctagagatagcaaaaagacccgtataattcctagacatttacaattggccataagaaatgacgaggaattgaacaaattactgtcaggagttaccatcgcccaaggtggagtattgcctaat

SEQ ID NO: 78 - DNA, 22 bp, Artificial Sequence
  primer
  misc_feature (1)..(22): forward primer
tggtaagggaggcaaagttaag

SEQ ID NO: 79 - DNA, 22 bp, Artificial Sequence
  primer
  misc_feature (1)..(22): reverse primer
attaggcaatactccaccttgg

SEQ ID NO: 80 - DNA, 456 bp, Diabrotica virgifera
  misc_feature (1)..(456): WCRW transcript ta07804.001_diavv
gggggaagggaggggagtattcacttgatcttcaaggtagattaacgcaagtagaaatctaaaacatgtctggacgtggtaagggaggcaaagttaagggaaaagcaaagtcccgatcaaatcgtgctggtttacaatttcctgtaggtcgtattcatcgtttattgagaaaaggaaattatgccgaaagagttggtgctggagctcctgtatacttggcagctgttatggaatatttagctgctgaagttttggaattggcaggaaatgcagctagagataacaaaaagacccgtataattcctagacatttacaattggccataagaaatgacgaggaattgaacaaattactgtcaggagttaccatcgcccaaggtggagtattgcctaatatacaagcagtacttttacctaaaaagaccgaaaaaaaaaaaaaaaaaaaaaaaaaaaaaa

SEQ ID NO: 81 - DNA, 759 bp, Diabrotica virgifera
  misc_feature (1)..(759): RNAi target sequence
atcatcctctgtgtttccgttttgaacttaacttgtatttagtttaaaaaataatcatgtctagaggaagcagtgcaggttttgaccgacacataacaattttctcgcccgaaggccgactctatcaagtagagtatgcttttaaagccattaaccaagccggccccacttcggtagcagtccgaggagtagatgctgcggcgtgtgtgacccagagaaagatcccggataagctgattgatcccaacacaattacacatctgttccagttaacagaacacactggatgtgtgatgactggcatgattgctgacagcaagtcccaggtgcagagagctagatatgaggctgccgagttcaaatataagtttggatatgagatgccaatcgatgccttgtgtaggagagtatcggatatttcccaggtttatacgcagaatgctgagatgagacctttgggttgctccatgcttctgataggatatgaccaagaaatgggaccatgtgtccacaaagctgaccctgctggctattactgtggctacagagcagtaagtgtaggatccaaacaaactgaagccaacagctacctagagaagaagctaaagaagaaaactgatctgtccaaagatgaagtcatccaattggcaatcagttgtctttcaagtgttttatctgtagattttaaaccaacagaagtcgaagttggggttgttactaaggatgagcccaagtttaggaaattgacggaacaagaaa

SEQ ID NO: 82 - DNA, 22 bp, Artificial Sequence
  primer
  misc_feature (1)..(22): forward primer
atcatcctctgtgtttccgttt

SEQ ID NO: 83 - DNA, 22 bp, Artificial Sequence
  primer
  misc_feature (1)..(22): reverse primer
tttcttgttccgtcaatttcct

SEQ ID NO: 84 - DNA, 957 bp, Diabrotica virgifera
  misc_feature (1)..(957): WCRW transcript ta04410.001
ggggccccgggggacagaagacagaacgtgacaacagaaaaatatagaaaatcatcctctgtgtttccgttttgaacttaacttgtatttagtttaaaaaataatcatgtctagaggaagcagtgcaggttttgaccgacacataacaattttctcgcccgaaggccgactctatcaagtagagtatgcttttaaagccattaaccaagccggccccacttcggtagcagtccgaggagtagatgctgcggcgtgtgtgacccagagaaagatcccggataagctgattgatcccaacacaattacacatctgttccagttaacagaacacactggatgtgtgatgactggcatgattgctgacagcaagtcccaggtgcagagagctagatatgaggctgccgagttcaaatataagtttggatatgagatgccaatcgatgccttgtgtaggagagtatcggatatttcccaggtttatacgcagaatgctgagatgagacctttgggttgctccatgcttctgataggatatgaccaagaaatgggaccatgtgtctacaaagctgaccctgctggctattactgtggctacagagcagtaagtgtaggatccaaacaaactgaagccaacagctacctagagaagaagctaaagaagaaaactgatctgtccaaagatgaagtcatccaattggcaatcagttgtctttcaagtgttttatctgtagattttaaaccaacagaagtcgaagttggggttgttactaaggatgagcccaagtttaggaaattgacggaacaagaaatagatttccatctgacagctattgctgagagggattagatagattttttatattcactctttgtaatgttaagaaatggtcaaattttgagttaagtaagaaataaatttttctcttataaaaaaaaaaaaaaaaaaaaaaaaaaaaa

SEQ ID NO: 85 - DNA, 587 bp, Diabrotica virgifera
  misc_feature (1)..(587): RNAi target sequence
aactttgtgtgttttggcaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcaggtagaactcgccttatgggataccgcaggtcaagaagattatgatcgtctgcggcccctttcatatccagacaccgatgtgattttaatgtgcttctcagtagactcccccgactcattagaaaacatcccagaaaaatggaccccagaggtaaaacacttttgtccaaatgtgccaattattctggtaggcaataagaaggatctgcgtaacgaccctactaccattaacgaacttaaaaagatgaaacaagaaccagtaaaacctcaagacggaagatccatggcagagaaaatcaatgcttttgcatatctagaatgttctgccaaaagtaaggagggtgtaagagaggtttttgaaaatgctacccgagctgcactgcaagtcaaaaagaagaagaagcccc

SEQ ID NO: 86 - DNA, 22 bp, Artificial Sequence
  primer
  misc_feature (1)..(22): forward primer
aactttgtgtgttttggcaggt

SEQ ID NO: 87 - DNA, 20 bp, Artificial Sequence
  primer
  misc_feature (1)..(20): reverse primer
ggggcttcttcttctttttg

SEQ ID NO: 88 - DNA, 1530 bp, Diabrotica virgifera
  misc_feature (1)..(1530): WCRW transcript ta15897.001_diavv
ggggatttaatgtccgccattttcgttcgtagttgaataggcgttaactttgtgtgttttggcaggtccgatggctgcaataagaaaaaaattggtgattgttggtgacggagcatgtggaaaaacatgtcttttaatagtatttagtaaagatcagttcccagaagtatacgtgcccactgtattcgaaaactatgtggcggatattgaagtagatggaaagcaggtagaactcgccttatgggataccgcaggtcaagaagattatgatcgtctgcggcccctttcatatccagacaccgatgtgattttaatgtgcttctcagtagactcccccgactcattagaaaacatcccagaaaaatggaccccagaggtaaaacacttttgtccaaatgtgccaattattctggtaggcaataagaaggatctgcgtaacgatcctactaccattaacgaacttaaaaagatgaaacaagaaccagtaaaacctcaagacggaagatccatggcagagaaaatcaatgcttttgcatatctagaatgttctgccaaaagtaaggagggtgtaagagaggtttttgaaaatgctacccgagctgcactgcaagtcaaaaagaagaagaagccccgttgtgtaatgttttgagccactacatattctatattttatattaataatcgttacgtgtgttaattaatttcaagggggcttctgcatgatgtattgactaacaaaataaacccctacttttctcttcagttctatttgttcaaactccttttctccttgtggacaaatttaagtattaagttatattttcatatgtatttaacccattgtttattggttcttagagttacacgacccagaaatttaattttaaaacaacacaacgatgtagcaagttactttttagagtttaatatagaatagatcattattttgtttctttattccccaccaaactagtattgcacattgcaattatttggctatgaattttaattgattaatgtaaaattttgatttttgaaatatccttagttgtctcgatttttgatgaacttccagtgaggggtgtgtaacttataagctttttttatacaatggtaaatgatataatcagtgtcatgtgcacaaaacttattgaacgtccacttagatcatcattgtagtactaatttacaagcatacgttgattcattttatagtatttatattttataacctgatcaatatattttgtttcaaaaatttttttctgtatctatagttatcttttacagatattcagagtacccattgatttttatttagttcaatgactgcagcacatttattatgttttgattagaagtcactgcaaatgaaacaagtggattaaaacttttgactaacagatacacaaaaaaatgtttgtgttgcagttattgcactgggactaaaaggactaacagtgatgtcatctcttgtgtaagggtagttactaccacctgttgtcctttaagtctcaaaattaattttga

SEQ ID NO: 89 - DNA, 444 bp, Diabrotica virgifera
  misc_feature (1)..(444): RNAi target sequence
cggcgttgtaaaccttttgtaaacattaaacattttgaaaattactgtattgctgcagcgatttacgtagaagtattttaagatgaatgcgcctccgacctttgaatcgtttttattatacgatggagagaaaaagatcattctagaacaagatacgaaagttccaaatgcagccatttttactatcaacaaagaggaccacacacttggtaatacgatcagaaaccaacttttaaaagatcccaacgtattattcgctggttacaaactacctcatccattggaacacaaatctgtcttgcgaattcaaacaacatcagactattcacctcaagaagccttaatgcacgctatcactgatttaatttcagaattgtccttgttcgaagaaagatttaaggaagcgatcaaagaaaagaaggaaggattggattaggcagtgaa

SEQ ID NO: 90 - DNA, 21 bp, Artificial Sequence
  primer
  misc_feature (1)..(21): forward primer
cggcgttgtaaaccttttgta

SEQ ID NO: 91 - DNA, 22 bp, Artificial Sequence
  primer
  misc_feature (1)..(22): reverse primer
ttcactgcctaatccaatcctt

SEQ ID NO: 92 - DNA, 575 bp, Diabrotica virgifera
  misc_feature (1)..(575): WCRW transcript ta06570.001_diavv
caaataacaggaaattgacactgacagttcgttggacaggaatgattttttcggcgttgtaaaccttttgtaaacattaaacattttgaaaattactgtattgctgcagcgatttacatagaagtattttaagatgaatgcgcctccgacctttgaatcgtttttattatacgatggagagaaaaagatcattctagaacaagatacgaaagttccaaatgcagccatttttactatcaacaaagaggaccacacacttggtaatatgatcagaaaccaacttttaaaagatcccaacgtattattcgctggttacaaactacctcatccattggaacacaaatttgtcttgcgaattcaaacaacatcagactattcacctcaagaagccttaatgcacgctatcactgatttaatttcagaattgtccttgttcgaagaaagatttaaggaagcgatcaaagaaaagaaggaaggattggattaggcagtgaatttttactttgatttagcttttgtaattaaggttaatgtgactaataaatatagttttattcaaaaaaaaaaaaaaaaaa

SEQ ID NO: 93 - DNA, 453 bp, Diabrotica virgifera
  misc_feature (1)..(453): RNAi target sequence
ctggttgtcataggttgtacgcagttaaattttttgtgataaaacttagtgttcctttgttatcaattaacatatataaaaatagtaatggctagtcggaagaagactttgttgaaggtcaccatcctgggtgattccagtgtgggaaagacttccttgatgaaccagtacgtaaataggaaattctccaaccaatacaaagcgaccataggtgctgatttccttacaaaagaactcacagtggacgatcgaactgttacaatgcaaatatgggatactgcaggtcaggaaaggtttcagtccttaggtgtagccttttacagaggggcagactgctgtgtgttagtatttgatgtaacttcccccacctcattcaaatccctggacagttggcgagacgaattcctcatccaagcatcgccccgagagccagaaaacttcccattgacctca

SEQ ID NO: 94 - DNA, 22 bp, Artificial Sequence
  primer
  misc_feature (1)..(22): forward primer
ctggttgtcataggttgtacgc

SEQ ID NO: 95 - DNA, 22 bp, Artificial Sequence
  primer
  misc_feature (1)..(22): reverse primer
tgaggtcaatgggaagttttct

SEQ ID NO: 96 - DNA, 640 bp, Diabrotica virgifera
  misc_feature (1)..(640): WCRW transcript ta40942.001_diavv
tagtaatggctagtcggaagaagactttgttgaaggtcaccatcctgggtgattccagtgtgggaaagacttccttgatgaaccagtacgtaaataggaaattctccaaccaatacaaagcgaccataggtgctgatttccttacaaaagaactcacagtggacgatcgaactgttacaatgcaaatatgggatactgcaggtcaggaaaggtttcagtccttaggtgtagccttttacagaggggcagactgctgtgtgttagtatttgatgtaacttcccccacctcattcaaatccctggacagttggcgagacgaattcctcatccaagcatcgccccgagagccagaaaacttcccattgacctcaagcgttattatccttataatacccttggtaccttaataactataagtacaagaagattccactataatattgttacaaattaagaaagtaacatattagatatattcaatcctttatatctctgaaaatattaaaaaaagcatacatctgatttacaaaagaaataagttgtaaaaatgcataagctctcagctgtaaatgtttttttgtgtcctttagtattattccagtgtttttaatatatctcataatattggaatattttttaa

SEQ ID NO: 97 - DNA, 601 bp, Diabrotica virgifera
  misc_feature (1)..(601): RNAi target sequence
gtgaacgccattgtgaactctaacgactttggaaccaagctgaagtaatccgtgattttttgtgccatcggtgtttcctagtactttttattcacaagtttaaattcaaaaaatcatggctggcgaacaagatatgcccaccttcaaatgcgtcttggtcggagatggaggtactggcaaaactacctttgtaaaaagacacatgactggtgaattcgaaaagaaatatgtagcaaccttaggagtagaagttcaccctttagttttccacacaaatagaggacaaattcgttttaacgtatgggacacagcaggccaagaaaagtttggtggtctgcgtgatggatactacatccaaggacaatgtgccataattatgtttgatgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccataggaagaagaatttacaatactatgacatctctgcaaaatccaactacaactttgaaaaacccttcttgtgg

SEQ ID NO: 98 - DNA, 22 bp, Artificial Sequence
  primer
  misc_feature (1)..(22): forward primer
gtgaacgccattgtgaactcta

SEQ ID NO: 99 - DNA, 22 bp, Artificial Sequence
  primer
  misc_feature (1)..(22): reverse primer
ccacaagaagggtttttcaaag

SEQ ID NO: 100 - DNA, 1075 bp, Diabrotica virgifera
  misc_feature (1)..(1075): WCRW transcript ta05966.001_diavv
tatttggcgcgcattcctgacacctacgcgggtcttcttgtgaacgccattgtgaactctaacgactttggaaccaagctgaagtaatccgtgattttttgtgccatcggtgtttcctagtactttttattcacaagtttaaattcaaaaaatcatggctggcgaacaagatatgcccaccttcaaatgcgtcttggtcggagatggaggtactggcaaaactacctttgtaaaaagacacatgactggtgaattcgaaaagaaatatgtagcaaccttaggagtagaagttcaccctttagttttccacacaaatagaggacaaattcgttttaacgtatgggacacagcaggccaagaaaagtttggtggtctgcgtgatggatactacatccaaggacaatgtgccataattatgtttgatgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccataggaagaagaatttacaatactatgacatctctgcaaaatccaactacaactttgaaaaacccttcttgtggttggctaggaaactcattggagatcccaacttagaattcgtagctgcacctgccttgcttcctccagaagtccagatggatccccaatggcagcaacaaatcgaaaaggatcttaaagaagcctcagaaactgcactgcccgatgatgacgaagatttataaactcattaaccaattactaaaactctgtcatcgttccaaagcgcgtgtgtaacaattgatatcttacaagacttaagttaaattacattttatgtatttctgaagcagaactgttgatatttttatataaatgttttctaaatttgttgaaaggtttgtctggagtctggacgtatgttcttcaatatattagtggtatggttgttagagtgttagagtcagcaagctaccgtaacagttcttgtcacataggagtgtagtcttaatttcaat

SEQ ID NO: 101 - DNA, 614 bp, Diabrotica virgifera
  misc_feature (1)..(614): RNAi target sequence
caacaattttcgcatctttctgtctgttcccggcgttctttgaaaaagttttcaataatactctaaaaaatggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaa

SEQ ID NO: 102 - DNA, 22 bp, Artificial Sequence
  primer
  misc_feature (1)..(22): forward primer
caacaattttcgcatctttctg

SEQ ID NO: 103 - DNA, 22 bp, Artificial Sequence
  primer
  misc_feature (1)..(22): reverse primer
tttttcgatctgaccaatgcta

SEQ ID NO: 104 - DNA, 1515 bp, Diabrotica virgifera
  misc_feature (1)..(1515): WCRW transcript ta03347.002_diavv
ttggaaaacgcaatatatctatagaaaacaagcggtttatttgccgccattttgacaagcttacgtacctacatttttaattcgttgttttatttttagttttcaataatactctaaaaaatggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtcatgatgttcagtgccaccttaagtaaagaaattagaccagtttgcaagaaatttatgcaagatcccatggaagtatatgttgacgacgaagctaaattaacattgcatggtctacagcaacattatgtaaaactaaaagaaaacgaaaagaataaaaagttatttgagttactagatgttttggagttcaaccaggttgtcattttcgtaaaatccgtacaaaggtgtgtggccctggcacaattactgactgaacagaacttcccagcgataggaattcacagaggaatggaccaaaaagaacgactgtcccggtatgaacaattcaaggatttccaaaagaggattctagtagccacaaacttatttggacgtggaatggatatcgaaagagtgaacatcgtcttcaactatgacatgcccgaagattctgacacttacctgcacagagtagcccgagctggacgtttcggtaccaaaggtctagccattactttcgtatcagaagagggagatgccaaaatattgaacgaagtacaagaaagatttgatgttaatattactgaattacctgacgaaatagatctcagttcatacattgaaggacgataagaatttcaagatctttgaagaattaattttaagatttagaataagatttccactaggtttaacgatttcaatttgtattatgtttcaatgttattgcattagtattaaaataaatgg

SEQ ID NO: 105 - DNA, 683 bp, Diabrotica virgifera
  misc_feature (1)..(683): RNAi target sequence
ggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagctcgtgccattgttgctattgaacaccctggtgaagttttcgtaatttcatctcgtccccatggccagcgtgctgttcttaagtttgctgctcacactggagctacccctattgctggaagatttactcctggtgcttttaccaatcagatccaagctgcattcagggaacctcgtctgttgatcgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttagaggaatcattccacgggataccaaatgggatgttgtagtagatcttttcttctaccgtgaaccagaagaggctgaaaaggaaga

SEQ ID NO: 106 - DNA, 22 bp, Artificial Sequence
  primer
  misc_feature (1)..(22): forward primer
ggcatcttgtctcgtttatcgt

SEQ ID NO: 107 - DNA, 22 bp, Artificial Sequence
  primer
  misc_feature (1)..(22): reverse primer
tcttccttttcagcctcttctg

SEQ ID NO: 108 - DNA, 822 bp, Diabrotica virgifera
  misc_feature (1)..(822): WCRW transcript ta15911.001_diavv
gggggacagagacaggacataagcattaaaagggacgtaaaaacaacaaaggggctctttctcgtgcaaataacccaagtggcatcttgtctcgtttatcgtaactcaaattaaacgtaaagatgtcgggaggaatcgaggctttaagccttaaagaggacgatgttaccaagatgttggcggcttccacccatcttggaacagcaaatgttgattttcaaatggaacagtatgtatacaaacgtcgtcatgacggtactcacatcatcaacttaaggaaaacgtgggaaaagattctcttggcagcccgtgccattgttgctattgaacaccctggtgaagttttcgtaatttcatctcgtccctatggccagcgtgctgttcttaagtttgctgctcacactggagctacccctattgctggaagatttactcctggtgcttttaccaatcagatccaagctgcattcagggaacctcgtctgttgatcgtcactgaccctgcttttgatcaccaacctatcactgaagcctcttacgtaaacattccagttattgctttgtgcaatactgattctccattacgttttgttgatattgccattcccggaaacaacaaagcctcacacagtattggtttactgtggtggcttttggctagagaggttctccgtcttagaggaatcattccacgggataccaaatgggatgttgtagtagatcttttcttctaccgtgaaccagaagaggctgaaaaggaagaacaagctgccaaagaagctgtggctgctgttgtcaaacctgtagatatcccagctcctc

SEQ ID NO: 109 - DNA, 559 bp, Diabrotica virgifera
  misc_feature (1)..(559): RNAi target sequence
ggatggtttattgtctggaagctcattctaagtagattccgttttattaaagaactgttgaagggagcaagtgactctacaattacggaattgaaaaacactaggagtaaactcaagaggacaagaaaggactgatttatcttctcaaaatgaatattcgatgtgcaaaaccagaagatcttatgaacatgcagcactgcaatctgttatgtctaccagaaaactatcagatgaaatattacttttatcatggccttagttggccccaactaagttatgtagctgaagacgaaaaaggtaacatagttggttatgtcctagcaaaaatggaagaagaccaagaagatctcaagcatggtcacataacctccctggcagtgaagcgatcccacaggcgattagggctagcccagaaactgatggatcaagcttcagaagccatggtcgaatgtcttgacgcaaaatatgtttcgctgcatgttcgtaaaagcaatcgcgccgctttaaatctatacaaaaactctttgaaatttgaaactgtcgaaattgagccaaaata

SEQ ID NO: 110 - DNA, 22 bp, Artificial Sequence
  primer
  misc_feature (1)..(22): forward primer
ggatggtttattgtctggaagc

SEQ ID NO: 111 - DNA, 22 bp, Artificial Sequence
  primer
  misc_feature (1)..(22): reverse primer
tattttggctcaatttcgacag

SEQ ID NO: 112 - DNA, 903 bp, Diabrotica virgifera
  misc_feature (1)..(903): WCRW transcript ta05802.003_diavv
aaatatgcacttgtgacggcctttgacctaaatgtttagttaggaacaaaatggcgaaatgttggaactgataaacatcactgcctttttgtaatagttaagaattagatttttaattggaaaattgtaatgtagcaaattacttaagcgcctaactccaagacccattaatgcattcaggttaaacagtttattttatttaggatggtttattgtctggaagctcattctaagtagattccgttttattaaagaactgttgaagggagcaagtgactctacaattacggaattgaaaaacactaggagtaaactcaagaggacaagaaaggactgatttatcttctcaaaatgaatattcgatgtgcaaaaccagaagatcttatgaacatgcagcactgcaatctgttatgtctaccagaaaactatcagatgaaatattacttttatcatggccttagttggccccaactaagttatgtagctgaagacgaaaaaggtaacatagttggttatgtcctagcaaaaatggaagaagaccaagaagatctcaagcatggtcacataacctccctggcagtgaagcggtcccacaggcgattagggctagcccagaaactgatggatcaagcttccgaagccatggtcgaatgttttgacgcaaaatatgtttcgctgcatgttcgtaaaagcaatcgcgccgctttaaatctatacaaaaactctttgaaatttgaaactgtcgaaattgagccaaaatattatgcagatggtgaagatgcatattccatgagacgagacttatctgaattcgctaagaaagttaaacctaagtctgagactaaaaacgaagaatagtgtaattatttgtaatttttgtatttatagcgaatataatataca

SEQ ID NO: 113 - DNA, 368 bp, Diabrotica virgifera
  misc_feature (1)..(368): RNAi target sequence
ggttgcagaagatttcacaaaactttattatgatactctggataaacgacggcatttgatagcaagactgtatttggagacgggattattatcatggaatggtaatggtgtaactgggaatgaaaatattttgaaatttatgattgatttaccaccgtcatcttttactatacaaactctagacgcacagcctgttttagattctgcagtaaatggacaactgaccttcatcactcaagtgactggcagtgtaaaataccaagagaaaacaccaaaaacctttcagcgaaacttcataattacagcacagggcgataaatggaaaattgtcagtgattgtatgaggctgcaagaaccattaaacgcta

SEQ ID NO: 114 - DNA, 21 bp, Artificial Sequence
  primer
  misc_feature (1)..(21): forward primer
gttgcagaagatttcacaaaa

SEQ ID NO: 115 - DNA, 22 bp, Artificial Sequence
  primer
  misc_feature (1)..(22): reverse primer
tagcgtttaatggttcttgcag

SEQ ID NO: 116 - DNA, 470 bp, Diabrotica virgifera
  misc_feature (1)..(470): WCRW transcript ta08838.001_diavv
atttatgagaaatggaagatttaaggctaaaaattgatcaggcctgtaaggttgcagaagatttcacaaaactttattatgatactctggataaacgacggcatttgatagcaagactgtatttggagacgggattattatcatggaatggtaatggtgtaactgggaatgaaaatattttgaaatttatgattgatttaccaccgtcatcttttactatacaaactctagacgcacagcctgttttagattctgcagtaaatggacaactgaccttcatcactcaagtgactggcagtgtaaaataccaagagaaaacaccaaaaacctttcagcaaaacttcataattacagcacagggcgataaatggaaaattgtcagtgattgtatgaggctgcaagaaccattaaacgctaagaactaacaactgtatttttaagtattttgataaataaagtaattggtagac

SEQ ID NO: 117 - DNA, 589 bp, Diabrotica virgifera
  misc_feature (1)..(589): RNAi target sequence
acctggctgatgcaatagatttggtaaaagggttttctacctataaatttacaatatattattataaatagactaaactcatcaataaaaaagtttaagcaaatagccatatagctacaatggccgaagacgatgcaatctttgatccaaccctcaaaaaaaagaaaaagaagaagaagaccactttcgacattgatgctgctctagctgaaggtaacattgaaaatgattcagggaatgccccagctgcagaagctgataatattgaatcaaaacctgacgatgatcaggatgatggaaatgtggacattgatttagatttcactaaaaagaaaaagaagaagaaaaagcctttctcagctgatgatttagattcttccccagctgataataaagctgaaactactcaagatggagctggggacaatgatgggggtatggatgataactttgatttagatatggactttagtaaaaagaagaagaagaaaaccaagaaacctaagaatttagacgaacttattgcagaaactgaggagaaggatgatgatcaggagaatgtagatgaaaattcaacacaatgggtcaa

SEQ ID NO: 118 - DNA, 22 bp, Artificial Sequence
  primer
  misc_feature (1)..(22): forward primer
acctggctgatgcaatagattt

SEQ ID NO: 119 - DNA, 22 bp, Artificial Sequence
  primer
  misc_feature (1)..(22): reverse primer
ttgacccattgtgttgaatttt

SEQ ID NO: 120 - DNA, 1418 bp, Diabrotica virgifera
  misc_feature (1)..(1418): WCRW transcript ta00006.001_diavv
ggggtggagaagggtttcgtgtgaacagccgttgcacacgagtcagtcgatcctaagccctaggcgaaagccgatgttgatgtggttgggggacaacctggctgatgcaatagatttggtaaaagggttttctacctataaatttacaatatattattataaatagactaaactcatcaataaaaaagtttaagcaaatagccatatagctacaatggccgaagacgatgcaatctttgatccaaccctcaaaaaaaagaaaaagaagaagaagaccactttcgacattgatgctgctctagctgaaggtaacattgaaaatgattcagggaatgccccagctgcagaagctgataatattgaatcaaaacctgacgatgatcaggatgatggaaatgtggacattgatttagatttcactaaaaagaaaaagaagaagaaaaagcctttctcagctgatgatttagattcttccccagctgataataaagctgaaactactcaagatggagctggggacaatgatgggggtatggatgataactttgatttagatatggactttagtaaaaagaagaagaagaaaaccaagaaacctaagaatttagacgaacttattgcagaaactgaggagaaggatgatgatcaggagaatgtagatgaaaattcaacacaatgggtcaattccgatcgggactacacatatgacgaattactaaaccgtgcctttgaaataatgagagataaaaatccagatatggctgccggtaagaaacagaagttcgtcatgagacctcctcaagtagtcaaaatcggcgccaaaaagacgtcatttgcgaatttcacagagatatgcaaaatgcttcatcgtcaacccaagcatcttttagattttttactagctgaattgggtaccagcgggtctgtggacggtaataatcagctcatcattaaaggaaggtttcaacagaaacaaattgaaaatgtactcaggagatacatcaaggaatacgtcacttgtcatacatgtagatccccagatacaattcttcaaaaagacactagattgttcttcttacaatgtgaaacgtgtggttctaggtgttctgttgctagtattaaatcaggtttccaggctgtcacttccaaacgtgctgcaattcgagccaagacagcataggaaccttagatattgcaatacaataataaataggcactgttacagaagaaatttcaaagtgctaaagaataggtgttgtatgtgttatataatttgtactataaatctagctgaattgttaaatggaattaacaatcatattaatatcaacaattttaattatataacttttttattgattattaaattttaataaacagtaaataattatttatatttttcgtccataaaaaaaaaa

SEQ ID NO: 121 - DNA, 610 bp, Diabrotica virgifera
  misc_feature (1)..(610): RNAi target sequence
gtagcggaaccgtcaaaaagtcgggccctcgcaagagagttcgtcggggtaacccaaaaggacctggagacgtcgtcgagagatccgggaagaatctcgcactcttctcgaacaagccgaccgtgctcgtcgccaagctgaacaagaattgggagatgctcacgaacaattgaacgatcttggagcccaaaacgcttccttgtctgccgccaagaggaaattggaaaccgaattgcaaaccctccactcagaccttgacgaacttctcaacgaagccaagaactccgaagagaaggccaagaaggctatggtagatgccgctcgtctcgctgatgaactccgcgctgaacaagaccatgcccaaacacaagagaaactccgtaaagctctcgaagctcaaatcaaggacctccaagtacgcttggacgaagctgaagccaatgcccttaaaggaggaaagaaggctattgccaaattggaacaacgtgttagagaattagaaaatgaattagacggtgaacaaaggcggcacgcggatgcccaaaagaacttgagaaagtctgaacgtcgtatcaaggaacttagcttccaagctgaagaagaccgcaag

SEQ ID NO: 122 - DNA, 21 bp, Artificial Sequence
  primer
  misc_feature (1)..(21): forward primer
gtagcggaaccgtcaaaaagt

SEQ ID NO: 123 - DNA, 20 bp, Artificial Sequence
  primer
  misc_feature (1)..(20): reverse primer
cttgcggtcttcttcagctt

SEQ ID NO: 124 - DNA, 669 bp, Diabrotica virgifera
  misc_feature (1)..(669): WCRW transcript ta41130.001_diavv
gggcacacccattgggcgaaagggaatccggttcctattccggaacccggtagcggaaccgtcaaaaagtcgggccctcgcaagagagttcgtcggggtaacccaaaaggacctggagacgtcgtcgagagatccgggaagaatctcgcactcttctcgaacaagccgaccgtgctcgtcgccaagctgaacaagaattgggagatgctcacgaacaattgaacgatcttggagcccaaaacgcttccttgtctgccgccaagaggaaattggaaaccgaattgcaaaccctccactcagaccttgacgaacttctcaacgaagccaagaactccgaagagaaggccaagaaggctatggtagatgccgctcgtctcgctgatgaactccgcgctgaacaagaccatgcccaaacacaagagaaactccgtaaagctctcgaagctcaaatcaaggacctccaagtacgcttggacgaagctgaagccaatgcccttaaaggaggaaagaaggctattgccaaattggaacaacgtgttagagaattagaaaatgaattagacggtgaacaaaggcggcacgcggatgcccaaaagaacttgagaaagtctgaacgtcgtatcaaggaacttagcttccaagctgaagaagaccgcaagaaccacgaga

SEQ ID NO: 125 - DNA, 628 bp, Diabrotica virgifera
  misc_feature (1)..(628): RNAi target sequence
ccagtatttagaccggcatctcgtttttcccttattggaatttctgtccgcaaaaggaatttacaatgagaccgaactgttaaaagccaaattagatattctaagcaagactaatatgatagattatgctattgatatcagaaaacaactgtaccctgatcaggaaatacccgaggacctaaaacagaggcgtaatcatgttgtgcagcagctagcagagttgcaagaagaggttaagcctatccttaagattatggaatctgaagaagttatgaagaatatggaaaacatgagagattcgaaaacacttattacatatttgtcaaaagaattcaagtttgaaattgaattgatcgacagtcttcacaaactagccaaatacagatacgactgtggcaactacacagtatctacatcctacctgtacttctgtatgctggtattacctcctaatgacaggaactatcttagtgccttgtggggaaaattcgcttcagaaattctgtaccaaaactgggattcagccctggaagatctcaacaaactgagggaatatattgattccagtcccaatcagttttctggcaacagtttgcagcttctccaacagaggacttggttgatccat

SEQ ID NO: 126 - DNA, 22 bp, Artificial Sequence
  primer
  misc_feature (1)..(22): forward primer
ccagtatttagaccggcatctc

SEQ ID NO: 127 - DNA, 22 bp, Artificial Sequence
  primer
  misc_feature (1)..(22): reverse primer
atggatcaaccaagtcctctgt

SEQ ID NO: 128 - DNA, 1547 bp, Diabrotica virgifera
  misc_feature (1)..(1547): WCRW transcript ta05495.001_diavv
tttttagaggctacttctcgtagctctgcttgttgaattttaaaatattgaaagtagtaaatattgaagaaagtattaataacacaatcatggcaaagttcgacttaacttcgaagatgggccagtatttagaccggcatctcgtttttcccttattggaatttctgtccgcaaaaggaatttacaatgagaccgaactgttaaaagccaaattagatattctaagcaagactaatatgatagattatgctattgatatcagaaaacaactgtaccctgatcaggaaatacccgaggacctaaaacagaggcgtaatcatgttgtgcagcagctagcagagttgcaagaagaggttaagcctatccttaagattatggaatctgaagaagttatgaagaatatggaaaacatgagagattcgaaaacacttattacatatttgtcaaaagaattcaagtttgaaattgaattgatcgacagtcttcacaaactagccaaatacagatacgactgtggcaactacacagtatctacatcctacctgtacttctgtatgctggtattacctcccaatgacaggaactatcttagtgccttgtggggaaaattcgcttcagaaattctgtaccaaaactgggattcagccctggaagatctcaacaaactgagggaatatattgattccagtcccaatcagttttctggcaacagtttgcagcttctccaacagaggacttggttgatccattggtctctctttgtgtttttcaatcatgttatgggcagagaattgattattgaaatgttcttgtatagaccacactacctcaacgccatccagaccatgtgtcctcatatcttgaggtatttggctacagctgtaattattaatcgtggaaggagatcagcactgaaggacttagttaaagttattcagcaagaaagctacacttacagagatcccattacagagtttgtggaacacctttacgtcaacttcgatttcgatggagcccgtcaaaaattacacgaatgccaaacagttttactaaacgacttcttcctaatttcctgtttagacgaattcgtagaaaacgccagacttatgatcttcgagacattctgcagaattcatcaatgcatcagtataggcatgttagccgaaaagctcaacatgaatccagacgaagctgaatgctggatcgtgaatttgatcagaaacgcacgattggatgctaagatcgattctaagttagggcatgtggttatgggtgctcaacctttatcgccataccagcaacttattgaaaaaattgattccctttcggtcaggtcagaaactctgtgtgctcttatagatagaaagctcagagcgaggactgacgtaagtttctaaaggtacgttaacgaaatgatgcaagaatttgtcatttttgttacagatacgttggggaaatccagatttttaaatatctgttattttgtaataattttattggatacaaataaaagatctttccagtatgtcaaaaaaaaaaaaaaaaaa

SEQ ID NO: 129 - DNA, 619 bp, Diabrotica virgifera
  misc_feature (1)..(619): RNAi target sequence
tcacattccagttgtttagagcacttagtagagatatacacctttaagcatgtcgtgttcagcgatatatattttagatgtaaaaggaaaagtcttaatctctaggaactatagaggcgatatagacctaggtgtaatagagaagtttatgcctttattaatggaaaaagaagaagaagggcttctaactccaattttgcaaatccctgaatgcaccttctcatatattaaaaccaacaatctatatatagtaagcactacgaagaaaaatggtaatatcgctcttgtatttgtatttttacataaaatcgttcaagtaatgactgaatattttaaagaattagaagaagaaagtatcagagataattttgtcgttatttatgagttgttggacgaacttttagactttggctatcctcaaacaactgatagcaaaattcttcaagaatacatcactcaagaaggtcataaactagagatacaaccaagaattcctgtagctgtgacaaatgcagtttcatggcgttctgagggaatcaaatacaggaaaaatgaagtattcttagatgtaatcgagtcagtaaatcttttagcaagtgcaaatggcaatgtactaaga

SEQ ID NO: 130 - DNA, 20 bp, Artificial Sequence
  primer
  misc_feature (1)..(20): forward primer
tcacattccagttgtttaga

SEQ ID NO: 131 - DNA, 20 bp, Artificial Sequence
  primer
  misc_feature (1)..(20): reverse primer
tcttagtacattgccatttg

SEQ ID NO: 132 - DNA, 2131 bp, Diabrotica virgifera
  misc_feature (1)..(2131): WCRW transcript ta08478.001_diavv
agtaaataataatgattataatatggtttgcaaatagttaaatgcagtatgtgattttctgaagaagtgaagaggttatatcacattccagttgtttagagcacttagtagagatatacacctttaaacatgtcgtgttcagcgatatatattttagatgtaaaaggaaaagtcttaatctctaggaactatagaggcgatatagacctaggtgtaatagagaagtttatgcctttattaatggaaaaagaagaagaagggcttctaactccaattttgcaaatccctgaatgcaccttctcatatattaaaaccaacaatctatatatagtaagcactacgaagaaaaatggtaatatcgctcttgtatttgtatttttacataaaatcgttcaagtaatgactgaatattttaaagaattagaagaagaaagtatcagagataattttgtcgttatttatgagttgttggacgaacttttagactttggctatcctcaaacaactgatagcaaaattcttcaagaatacatcactcaagaaggtcataaactagagatacaaccaagaattcctgtagctgtgacaaatgcagtttcatggcgttctgagggaatcaaatacaggaaaaatgaagtattcttagatgtaatcgagtcagtaaatcttttagcaagtgcaaatggcaatgtactaagaagcgaaatagtgggagcaataaaaatgagagtgtatctttctggtatgcctgaactgagattaggtctcaatgataaagtattattcgagagtacaggacgtggtaaatctaaatcggtagagttagatgatgttaagttccatcaatgtgtaagattatcaagattcgagatagatagaacaatctcttttattccaccagatggtgaatttgaattaatgtcttatcgtttaaatacccatgtgaaaccattaatatggattgaatctgttatagaaagacatgcgcatagtagagtggagtacatgattaaagctaaatcgcaattcaagagacgttctactgctaacaatgttgaaataatcattccagtgccacatgatgcagactctccgaagtttaaaaccaccatcggcagtgtcaagtatgcccctgaacaaaatgccataacttggagtatcaaatcattcccagggggtaaagagtatttgatgagagcccactttggtttacctagtgttgaatgtgaagatactgagggtaaaccacctattcaggtcaaatttgaaattccatattttacaacttctggaatacaagtcagatacttgaagattatagagaaaagtgggtatcaagctctaccatgggtgagatatattacacagaatggtgactaccagttgcgtactaattaagcgttgttattgtacttttctgctttttaagttagaatataatatatttttacttatactttatttgtagggtcttataaaactttgtactatgtagcactatattcagttaatatattttaaaataaacattactttttcatgtactgttctcacaattcattataacttgtttcagcattatctatttcaaaatatttaaagtatgtacttaaacatttgacattgaataaatttacctattttattcttaaattttgggtgctttgagacaagctcagcggttggacaactgagtaagcggtagcgtttagacaacacaatgacaagccactgttaaatttactaagcgtattttctttctgctgtgtaactcagtggttgcttgggtacagtacgcaataatgagtttaaatttttttaaacttttcataaaatattcaattgacccaaaaaatggatttacagtggaataagagaagtacattttggtactgtacgagaatatttatttctagaagtattatgtaaatattatgcaaatatgtttattactactggatctaagccgtttttgtagttaatgtcagccactgaggtcgtctgaatgtacccattggttatcctgtcttttatcaagttgccatgccttcaagcgtcggaaaagttttgattttaagagagtaggcgcaaaatttaactggattcatttttttcgaatcctgagaaaact

SEQ ID NO: 133 - DNA, 660 bp, Diabrotica virgifera
  misc_feature (1)..(660): RNAi target sequence
acctccaaaagaccatcaagaaacaatccctgcaactcaccgaaatccaggctcactatgacgaaatccaacgtcaattgcaagttactcttgaccaactcagcgtatcacaaagaagggtacaggcacttaccgccgaatctgaagaaatcaggagcaattatgaaggtgctcttcgtggtaagaggcaagccgagcaaatgtacgaagaagctggcactcgcatcaacgagctcaccaccatcaacgtcaacctttcttcaatgaaggtcaagattgaacaagaactgtcctcagttcttgctgactacgatgaaatcaccaaggaactccgcatttctgatgaacgctaccaacgtgtacaggccgaactcaaacataccgtcgaaatcctacatgaagagcaagagcgcgtggtcaagatcgaagctatcaagaagagtctggaaatcgaagtcaagaacctctcagtccgtttggaagaagtcgaagccaacgctatcgttggaggaaaacgtatcatcagcaaactcgaagctcgtatcagggattgcgaagctgaactcgatgaagaaaagagacgccacgccgaaaccatcaagatcttgcgcaagaaggaacgcactgttaaggaagtcatgatccaatgtgaagaggacc

SEQ ID NO: 134 - DNA, 22 bp, Artificial Sequence
  primer
  misc_feature (1)..(22): forward primer
acctccaaaagaccatcaagaa

SEQ ID NO: 135 - DNA, 21 bp, Artificial Sequence
  primer
  misc_feature (1)..(21): reverse primer
gtcctcttcacattggatcat

SEQ ID NO: 136 - DNA, 3369 bp, Diabrotica virgifera
  misc_feature (1)..(3369): WCRW transcript ta00254.002_diavv
aatcaagtatattcaaatgggaaacaagccacaatttcacctaaaaacgactttatcgacgtctcgacgctcatatacgaacgactctgccaccactgtcaggcggcgcaggcacgcggatttcaatcttgaaattttcgacggtcagtgcaccaacgacacgactatacattcacaaaaaagcaaaaaaatctcttgaagatggcttcttcctctgtggcgaggacctccaaatactcttaccgttccacaggagctgcaggaggcagtgctgacgtcagcatcgaatacagcgcggatctgacagcgctttctaggcttgaggataaaattcgcctacttcaggatgacctagaaattgaacgagaacttagatctagaatcgaaagagaaaaagccgaccttagtgtacaagtaatccaattatcagaacgtctagaagaagctgagggtggtgcagaaagtcagtttgaaattaacaaaaaacgtgacacagaattgctgaagcttcgcaaactattagaagatgtacacatagagtcagaagaaactgctctcatcctcaagaagaaacatcaagaaatcgttgtcgacttccaagaacagattgattccttagctaaagcaaaatcaagagccgaaaaagaaaagggcaaattccaagccgaaatctaccagctcatcgcccaggtcgaaagcgtaaccaaagaacgcttgatttccatcaaacaatgtgagaaactagaaatcaccgtcaacgagctcaacatcagaatcgaggagcttaaccgttccgtcgttgacatcacctcccacaagacccgtctctcccaagagaacatcgagctcatcaaggaagtccaagacctcaaggtcaatatcgaaaacgccatctacctcaagagccagctcgccggccaactagaggatgcccgccgccgtgctgaagacgatgaaagaagacgctcccttttggaggccaacctccaccaggtcgagatcgaacttgaatctgtccgtgtgcaacttgaggaagaaagcgaagctcgtcttgaccttgaacgtcaattggtcaaatcccaaggtgaggttcaagtctacaaatccaaatatgaaaccgaagtcgttgctcgtgctgaagaagttgaagaaatccgtcgcaaattcaccatcagaatccaagaacaagaagaacacattgaagccctcttggtcaaggtcaacaacctcgagaagcaaaagtcccgcctccaatccgaagtcgaggttcttatcattgacttggagaaagcaaataacaccgctagagaacttcaaaaacgcgttgaacaactcgagagaatcaatattgacttgaagacccgtctcgatgaaacagttcaattgtacgagcaaagccaacgtgacctccgtaacaaggttactgaattgcaacgcgctgtacacgaattggacaaaactcgcgaactgaaggaccaacttgccagagaaaacaagaaattatgcgacgatctcagcgactccaagattaccattaccgagcttactcgtcgtctccatgaactcgacttggaagttcgccgtttggaaaatgaacgtgatgaacttactgcagcctacaaagaagctgaagccggacgtaaagctgaagaacaacgtgcccaacgccttgccgccgaacttggtcaattccgtcacgaagccgaaaaacgtcttcaagaaaaagacgaagaaattgaagctatccgcaaggcaaccagcatcgaaattgaacagctcaatgcccgcgtcgttgaagccgaaaccaggctcaagactgaggtcacccgcatcaagaagaagttgcagatccaaatcaccgagctcgagatgtccttggactccgccaacaaactcaacatcgacctccaaaagaccatcaagaaacaatccctgcaactcaccgaaatccaggctcactatgacgaaatccaacgtcaattgcaagttactcttgaccaactcagcgtatcacaaagaagagtacaggcacttaccgccgaatctgaagaaatcaggagcaattatgaaggtgctcttcgtggtaagaggcaagccgagcaaatgtacgaagaagctggcactcgcatcaacgagctcaccaccatcaacgtcaacctttcttcaatgaaggtcaagattgaacaagaactgtcctcagttcttgctgactacgatgaaatcaccaaggaactccgcatttctgatgaacgctaccaacgtgtacaggccgaactcaaacataccgtcgaaatcctacatgaagagcaagagcgcgtggtcaagatcgaagctatcaagaagagtctggaaatcgaagtcaagaacctctcagtccgtttggaagaagtcgaagccaacgctatcgttggaggaaaacgtatcatcagcaaactcgaagctcgtatcagggattgcgaagctgaactcgatgaagaaaagagacgtcacgccgaaaccatcaagatcttgcgcaagaaggaacgcactgttaaggaagtcatgatccaatgtgaagaggaccaaaagaacatcgctctattgcaagaaactttagacaaggctaattcgaagattactattttcaagagacaactacaagaagtcgagggtgtatctagccaaagcataactcgcgtacgtcgattccagagggaattggaagccgccgaagaccgtgccgaaaccgccgaaagcaatctgtccctcatccgcgccaaacaccgcactttcgtcaccaccagcacagtacctggctcccaagtctacttggtacaagaacaacgagcatcttccgaaatctaatcatctcctattctagctactaataaactaccccatccggccgaataacaacgtcaaagacatttatccatacagcagcgacatctgcgaaggaaaacttgagttggaagactcgtttcccttcgtcagtttcttgctgtgtgtaaacttgtctttgggctcgcgacatggtggaagacatcatcatacaagatcatttttttttgttcttcgtgcacataattaaataatatttaccactctctttgaaatattattattattattataacgaaacgtacatatttcattaaataaattaataaaatgagtaagcgatttatatttgtttgcaatcgcacgatgagtccatggtatggaaatttgtaggtttctaataaactgttatgttatgtaattgtacttatatcactgatgtgtgcttctattagaggtacaagggttattggaatgtaatttataagtttttgaatgtaccgtgtaagaataaattgcttataaataaaaaaaaaaaaaaaaaatcgg

SEQ ID NO: 137 - DNA, 589 bp, Diabrotica virgifera
  misc_feature (1)..(589): RNAi target sequence
cgatttatcagcttcccaattctctcctgatggaagagtatttcaagttgaatatgcaatgaaagcagttgaaaatagtggcaccgtaataggcctccgaggtacagatggcattgtattggctgctgaaaagctcattatgtcaaaattgcatgaaccaagtacaaataaacgaattttcaacattgataaacacataggaatggcattttcaggcttaatagctgatgcaaggcaaatcgttgagattgctagaaaagaagcatcaaattatagacatcaatatggttcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccatctggagttagctatggatactttggatgtgctacaggtaaagcaaaacagtctgcaaagactgaaatagaaaaattgaagatggggaatctaacatgcaaagaacttgttaaagaagcagccaaaatcatttatttggtccatgatgagctg

SEQ ID NO: 138 - DNA, 22 bp, Artificial Sequence
  primer
  misc_feature (1)..(22): forward primer
cgatttatcagcttcccaattc

SEQ ID NO: 139 - DNA, 22 bp, Artificial Sequence
  primer
  misc_feature (1)..(22): reverse primer
cagctcatcatggaccaaataa

SEQ ID NO: 140 - DNA, 956 bp, Diabrotica virgifera
  misc_feature (1)..(956): WCRW transcript ta06609.001_diavv
aaaaaatcaaaatgagttctattggaactgggtacgatttatcagcttcccaattctctcctgatggaagagtatttcaagttgaatatgcaatgaaagcagttgaaaatagtggcaccgtaataggcctccgaggtacagatggcattgtattggctgctgaaaagctcattatgtcaaaattgcatgaaccaagtacaaataaacgaattttcaacattgataaacacataggaatggcattttcaggcttaatagctgatgcaaggcaaatcgttgagattgctagaaaagaagcatcaaattatagacatcaatatggttcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccatctggagttagctatggatactttggatgtgctacaggtaaagcaaaacagtctgcaaagactgaaatagaaaaattgaagatggggaatctaacatgcaaagaacttgttaaagaagcagccaaaatcatttatttggtccatgatgagctgaaggataagaattttgaactggaactttcatgggtatgcaaagatacgaatggtttacataccaaagtgcctgaatcagtgtttgctgatgcagaaaaagctgccaaacaagcaatggaagcagattcagaatcagatacagaagatatgtaataactacatttagtttttaatatttcgctgatggtggctgttcttacaatatttcgtgtgttatgttcatatattatgtaatactgtgagaatttccatttcaaggataggtttataacttttttttctaataaatacataactttatgtcaaaaaaaaaaaaaaaaaaaaaaaaaaaaa

SEQ ID NO: 141 - DNA, 577 bp, Diabrotica virgifera
  misc_feature (1)..(577): RNAi target sequence
aattggtgcagatacacgtttgagtactggattttccatttataccagagaacaaaacaaacttttcccactatcaggcactactgttttgggttgtgcaggatgttggtgtgacactctaacattaaccagaatccttaaatctcgcatgcagatgtaccaacaagagcataacaaaacaatgtctacaactgcatgtgcccagatgttgtcaaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggggaacctcttagtcaggagaaagctctgtctacccttaaagatgtatttatttctgctgctgaaagagacatctacactggagatagcgtacttataaatattattactaaagatggagtaaaggaagagtccttccagttgagacgggattag

SEQ ID NO: 142 - DNA, 22 bp, Artificial Sequence
  primer
  misc_feature (1)..(22): forward primer
aattggtgcagatacacgtttg

SEQ ID NO: 143 - DNA, 22 bp, Artificial Sequence
  primer
  misc_feature (1)..(22): reverse primer
ctaatcccgtctcaactggaag

SEQ ID NO: 144 - DNA, 913 bp, Diabrotica virgifera
  misc_feature (1)..(913): WCRW transcript ta03835.001_diavv
gggggcagttatttcgacttttcatgcttgtcataaaataaaattaaaatatatccggcgaggtgttgactagcggatttttttagattcaacaatcttattttataaaataattagttaaaatgatgcaaacagctaataatgcatattatcccgattattccactgctccaatgcaacgtcaaattaacccctatgcagataatggagggagtgtagtagcaatagcaggtgaagactttgtaataattggtgcagatacacgtttgagtactggattttccatttataccagagaacaaaacaaacttttcccactatcaggcactactgttttgggttgtgcaggatgttggtgtgacactctaacattaaccagaatccttaaatctcgcatgcagatgtaccaacaagagcataacaaaacaatgtctacaactgcatgtgcccagatgttgtcaaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggggaacctcttagtcaggagaaagctttgtctacccttaaagatgtatttatttctgctgctgaaagagacatctacactggagatagcgtacttataaatattattactaaagatggagtaaaggaagagtccttccagttgagacgggattagaagcaagtggttttgtttatattttcttatgtgaaattcaaatatactttctaaataaacaaaaaaaaaaaaaaaaaaaaaaaaaaaaa

SEQ ID NO: 145 - DNA, 542 bp, Diabrotica virgifera
  misc_feature (1)..(542): RNAi target sequence
tcttcgttcaataccagcttcagtgatgatccccagtctgactacacctcctgaagaaccatctcttgacatggcaagtgccaatgtatttgtgacaaacttcacacattcttccttgctcatattgggcttgaagttggcatctacgtaaccataaacataactggaacctgatcctccgattgacacttcttgtctaacacacatcccaccaattggtatggaatatacttgtccgcctttctttttatcccaacctgctaccagtataccagccattagcgaatctctataattgtagcaaagttcttggaaaatggcggcacctacttgtactttgggttcttcaccaagttccataccatgaaaattaagatgataagcaacaatgtctgcaattgcttgtgtatctgctgcagatcctgaacgacaacagtatatatggtcagtgactttggtgagtttgtctgctacccggtttgcaatgtaggccccagtagttgtgcgagaatctgctcctataacaacgcctccatcaaact

SEQ ID NO: 146 - DNA, 22 bp, Artificial Sequence
  primer
  misc_feature (1)..(22): forward primer
tcttcgttcaataccagcttca

SEQ ID NO: 147 - DNA, 22 bp, Artificial Sequence
  primer
  misc_feature (1)..(22): reverse primer
agtttgatggaggcgttgttat

SEQ ID NO: 148 - DNA, 850 bp, Diabrotica virgifera
  misc_feature (1)..(850): WCRW transcript ta02145.001_diavv
attgcagggggactggcaaaatattgcattgtaggattacaagtgtaatttttctaagcttgtattcttttcattaaacttgtaaaaaatgcctcttatgactgagtatggtgcaatgactggtcctaatgattggagagatgccgctcacagtacaggaacctctattatggccgcggagtttgatggaggcgttgttataggagcagattctcgcacaactactggggcttacattgcaaaccgggtagcagacaaactcaccaaagtcactgaccatatatactgttgtcgttcaggatctgcagcagatacacaagcaattgcagacattgttgcttatcatcttaattttcatggtatggaacttggtgaagaacccaaagtacaagtaggtgccgccattttccaagaactttgctacaattatagagattcgctaatggctggtatactggtagcaggttgggataaaaagaaaggcggacaagtatattccataccaattggtgggatgtgtgttagacaagaagtgtcaatcggaggatcaggttccagttatgtttatggttacgtagatgccaacttcaagcccaatatgagcaaggaagaatgtgtgaagtttgtcacaaatacattggcacttgccatgtcaagagatggttcttcaggaggtgtagtcagactggggatcatcactgaagctggtattgaacgaagagttgttttaggaaatgaattgcccaaattttatgaaggttaattgattattttttaagctttggtatgttttggtatatattaaaataaaaaaatcagttttacactaaaaaaaaaaaaaaaaaatcgg

SEQ ID NO: 149 - DNA, 559 bp, Diabrotica virgifera
  misc_feature (1)..(559): RNAi target sequence
ctgaattgaccaacaaattggattcaattagagggtttttacattctcgtttacgtaccgctacactcaggaacgactttgaaggtcaagctgtgtttataaattgcctgttgagaaattatttgcattattcgttgtatgatcaagctgacaaactagtgagtaaatgcgtatttcctgaaactgcaagtaacaatgaatgggccagattcttatactacttgggcagaattaaggcggcaagattagaatacagtgtagcacataaacatcttgtgcaggccatgagaaaagcaccccagaatgctgccattggtttcagacaggttgttcaaaagcttactgttgtagttgaactactgctaggagatataccagaacgacagatttttagacaatctagtatgaggcactcccttgccccatactttcaactaacacaagcagttagaatgggcaatttgcaaagatttggtgaggtgttagagaacttcggcccacaatttagacaagatcatacatttacactaattttgagactgcgccacaatgttattaa

SEQ ID NO: 150 - DNA, 22 bp, Artificial Sequence
  primer
  misc_feature (1)..(22): forward primer
ctgaattgaccaacaaattgga

SEQ ID NO: 151 - DNA, 22 bp, Artificial Sequence
  primer
  misc_feature (1)..(22): reverse primer
ttaataacattgtggcgcagtc

SEQ ID NO: 152 - DNA, 1711 bp, Diabrotica virgifera
  misc_feature (1)..(1711): WCRW transcript ta08208.001_diavv
ggggggaggggattgtcaaatagttgtcagcgttacacagcgaatattttcctcatcagttcaatattaacaataaattgttttgttgaaattgaaatcacaaattactttataaaatggtaactctagaagacgttgaaatgaaaaatgcagacagtcctccaggattagaagctggtgatacaaagaaagataccgacctacaaagtgtaatagaaattcgtgaacatgcaagacaaatagaaaaatcagtcacaagtaaagaaaaccgtttcatcttacgagttttacgttgcttgcccaacactagaaggaagcttaatggactggtgctgagaagcctcattactcaaatatatcctgtagctgaacgtgatgccctccttagtttcgtcgaggaagcttctggagaactcgacgccacccagtcacgagcaagatcagctgttaagtcacctgttcccgaggtagatacatatataaatcttttaatactagtacgtttaattgataccaataagttagttgaagcagagcgctgttctcaagctcttatgaataaaataactaaccaaaacagacgtactatagatcatattgctgccaagtgttatttctatcactcaagagttgctgaattgaccaacaaattggattcaattagagggtttttacattctcgtctacgtaccgctacactcaggaacgactttgaaggtcaagctgtgcttataaattgcctgttgagaaattatttgcattattcgttgtatgatcaagctgacaaactagtgagtaaatgcgtatttcctgaaactgcaagtaacaatgaatgggccagattcttatactacttgggcagaattaaggcggcaagattagaatacagtgtagcacataaacatcttgtgcaggccatgagaaaagcaccccagaatgctgccattggtttcagacaggttgttcaaaagcttactgttgtagttgaactactgctaggagatataccagaacgacagatttttagacaatctagtatgaggcactcccttgccccatactttcaactaacacaagcagttagaatgggcaatttgcaaagatttggtgaggtgttagagaacttcggcccacaatttagacaagatcatacatttacactaattttgagactgcgccacaatgttattaaaacagctataagatccataggattatcatactccagaatatctccccaagacatagctaagaaactggggctggattcagctgaagatgcagaatttatagtagcaaaagcaatcagagatggggtgatagaagctacacttgatccacagggaggttacatgaggagcaaagaaagtactgacatctactgcacaaaggaacctcaactggcgtttcatcaaagaatatcgttttgcttagatttgcacaatcaaagtgtcaaagctatgagatatccccccaaggcgtatggcaaagaacttgaatcagcagaagagagaagggaaagagaacagcaggatttggagttggccaaggaaatggctgaagaagatgatgatggttttccttaagttggtgtagttatcaatattaattttataacatttttgcttttgtatggtatttatagacagtagatttatcaaaatatactgagtaaaactccaaaaaaaaaaaaaaaaaaaaaaaaaaaaaa

SEQ ID NO: 153 - DNA, 473 bp, Diabrotica virgifera
  misc_feature (1)..(473): RNAi target sequence
atgtgtgatgactggcatgattgctgacagcaagtcccaggtgcagagagctagatatgaggctgccgagttcaaatataagtttggatatgagatgccaatcgatgccttgtgtaggagagtatcggatatttcccaggtttatacgcagaatgctgagatgagacctttgggttgctccatgcttctgataggatatgaccaagaaatgggaccatgtgtccacaaagctgaccctgctggctattactgtggctacagagcagtaagtgtaggatccaaacaaactgaagccaacagctacctagagaagaagctaaagaagaaaactgatctgtccaaagatgaagtcatccaattggcaatcagttgtctttcaagtgttttatctgtagattttaaaccaacagaagtcgaagttggggttgttactaaggatgagcccaagtttaggaaattgacggaacaagaaa

SEQ ID NO: 154 - DNA, 22 bp, Artificial Sequence
  primer
  misc_feature (1)..(22): forward primer
atgtgtgatgactggcatgatt

SEQ ID NO: 155 - DNA, 22 bp, Artificial Sequence
  primer
  misc_feature (1)..(22): reverse primer
tttcttgttccgtcaatttcct

SEQ ID NO: 156 - DNA, 879 bp, Diabrotica virgifera
  misc_feature (1)..(879): WCRW transcript 454run3_isotig15710
gtgacaacagaaaaatatagaaaatcatcctctgtgtttccgttttgaacttaacttgtatttagtttaaaaaataatcatgtctagaggaagcagtgcaggttttgaccgacacataacaattttctcgcccgaaggccgactctatcaagtagagtatgcttttaaagccattaaccaagccggccccacttcggtagcagtccgaggagtagatgctgcggcgtgtgtgacccagagaaagatcccggataagctgattgatcccaacacaattacacatctgttccagttaacagaacacactggatgtgtgatgactggcatgattgctgacagcaagtcccaggtgcagagagctagatatgaggctgccgagttcaaatataagtttggatatgagatgccaatcgatgccttgtgtaggagagtatcggatatttcccaggtttatacgcagaatgctgagatgagacctttgggttgctccatgcttctgataggatatgaccaagaaatgggaccatgtgtctacaaagctgaccctgctggctattactgtggctacagagcagtaagtgtaggatccaaacaaactgaagccaacagctacctagagaagaagctaaagaagaaaactgatctgtccaaagatgaagtcatccaattggcaatcagttgtctttcaagtgttttatctgtagattttaaaccaacagaagtcgaagttggggttgttactaaggatgagcccaagtttaggaaattgacggaacaagaaatagatttccatctgacagctattgctgagagggattagatagattttttatattcactctttgtaatgttaagaaatggtcaaattttgagttaagt

SEQ ID NO: 157 - DNA, 451 bp, Diabrotica virgifera
  misc_feature (1)..(451): RNAi target sequence
agataggcggtttggtattcaagcccaaacggtagctacaaatttccaaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaatatgttgtatgaaaaaagatttgggccattttttgtagaacctgtagtagctggacttctacctaatacttatgaaccctttatctgtaatatggatttaattggttgtataaaccaaccttcagactttgttgttggtggaacagcgtcagcacagttgtatggtatgtgtgaagcactttgggagcctaacctaggacctgaggatctttttgaaaccatctctcaagctctcatcaatgc

SEQ ID NO: 158 - DNA, 22 bp, Artificial Sequence
  primer
  misc_feature (1)..(22): forward primer
agataggcggtttggtattcaa

SEQ ID NO: 159 - DNA, 22 bp, Artificial Sequence
  primer
  misc_feature (1)..(22): reverse primer
gcattgatgagagcttgagaga

SEQ ID NO: 160 - DNA, 829 bp, Diabrotica virgifera
  misc_feature (1)..(829): WCRW transcript ta03399.001_diavv
gtttgcagagagtgtattagtgtattgtattttagtattttacaattctttgaattgcagattatttagcggtttagtacaaaaacctgaagtaaattctataacggaaagtgcttaaattttagtggtaaaatgtccattctagcttacaatggtggtgctatggtggcgatgaagggagaaaactgtgtagcaattgcagcagataggcggtttggtattcaagcccaaacagtagctacaaatttccaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaatatgttgtatgaaaaaagatttgggccattttttgtagaacctgtagtagctggacttctacctaatacttatgaaccctttatctgtaatatggatttaattggttgtataaaccaaccttcagactttgttgttggtggaacagcgtcagcacagttgtatggtatgtgtgaagcactttgggagcctaacctaggacctgaggatctttttgaaaccatctctcaagctctcatcaatgcctttgacagagatgccatttctggttggggagctacagtgtacatcatagaaaaaaataaggtgactgtaaaaaatttgaagacacgtatggactagttaaatcttgttttttcatttacatttaattgataaaataaatgaaactatttgataaaaaaaaaaaaaaaaaatgcga

SEQ ID NO: 161 - DNA, 530 bp, Diabrotica virgifera
  misc_feature (1)..(530): RNAi target sequence
cttcttcgactaggaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgctgatccagtgtttcaaacaaaaatgcttgacgtgttaagacagactggtaggccagaaatggttgtggggtggtatcattcccatccaggtttcggatgttggttgtctggagtggatatcaacacccagcaaagttttgaggctctcacggaaagagctgtagcagtagtagttgatccaatccagtcagtgaaaggcaaagtcgttattgatgcctttaggttaataaatccgaatatgatggtattgggccaagaacctcgccaaactacatc

SEQ ID NO: 162 - DNA, 22 bp, Artificial Sequence
  primer
  misc_feature (1)..(22): forward primer
cttcttcgactaggaggtggaa

SEQ ID NO: 163 - DNA, 22 bp, Artificial Sequence
  primer
  misc_feature (1)..(22): reverse primer
gatgtagtttggcgaggttctt

SEQ ID NO: 164 - DNA, 1190 bp, Artificial Sequence
  primer
  misc_feature (1)..(1190): WCRW transcript ta04924.001_diavv
tgacagatgacttgtaagggggaaaactaaaagtcatactcacggttgtttttgtaaaacttgtaggtaacgaattttcgtttttagtgaattaacaaaacaacagagtgattttccaacaagaataacttatttattagtttcattaatttgataaacaataaaatggatagacttcttcgactaggaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgttgatccagtgtttcaagcaaaaatgcttgacatgttaagacagactggtaggccagaaatggttgtggggtggtatcattcccatccaggtttcggatgttggttgtctggagtggatatcaacacccagcaaagttttgaggctctctcggaaagagctgtagcagtagtagttgatccaatccagtcagtgaaaggcaaagtcgttattgatgcctttaggttaataaatccgaatatgatggtattgggccaagaacctcgccaaactacatccaacttaggacatctacagaaaccatcagtccaggctttgattcatggtctaaatcggcattactactccatcagtattaattacagaaagaatgaattggaacaaaaaatgctactaaatctccataaaaaatcctggatggatggtctaactttagcagattactctgaaaattgtagtgtgaatgaaaagactgtagctgatatgttagaactagccaagaattacaacaaggcattagaagaggaggagaaaatgactccagaacagctcgctattaaaaatgttggcaaacaagatcctaagaggcatttagaagaaaaggttgatattttgatgaccaataatatcgtccagtgcttgggagctatgctagatacagttgtttttaagtaattgctggatctctttttttactataattgcaacttatttataagatattttttcaataaaaacttttattatgaatttgtgttgcgcag

SEQ ID NO: 165 - DNA, 654 bp, Diabrotica virgifera
  misc_feature (1)..(654): RNAi target sequence
acgatttttgaggttgtcggctagaagttcgcaaagtaaatctaaattccaacaattaaaccgaaatagttctttaaaaaagatgtttcgaaaccaatacgatagtgatgtgacagtgtggagcccccagggccgtctgcatcaggtagaatatgccatggaagcagttaacctaggttcagccacagtgggactgaaaagtaaaactcatgctgtacttatcgctttgaagagggcttcttcagaactgtctgcctaccagaagaaaattatcaacatagacgatcacattggtatcaccatctcgggacttacagctgatgctaggatccttagtagatatatgcgaaacgaatgcttgaattataagtactctttggatacttatatgccattgaataggcttatcagtattttaggtaacaaaatgcagacatgtacccaaagatacgaccgcagaccatttggtgtaggtcttctagtagctggttatgacgaatctggttctcatatctaccaaacgtgcccttctgctaatttctacgattgcaaagctatgtccattggagctcgatcccagagtgccaggacatacttagaaaaacatctggatgaattgccatctagttctttagaagaacttatcaaacatgg

SEQ ID NO: 166 - DNA, 22 bp, Artificial Sequence
  primer
  misc_feature (1)..(22): forward primer
atttttgaggttgtcggctaga

SEQ ID NO: 167 - DNA, 22 bp, Artificial Sequence
  primer
  misc_feature (1)..(22): reverse primer
ccatgtttgataagttcttcta

SEQ ID NO: 168 - DNA, 1142 bp, Diabrotica virgifera
  misc_feature (1)..(1142): WCRW transcript ta04466.001_diavv
gggggagggggacagtcgacgtagcattacaaacgatttttgaggttgtcggctagaagttcgcaaagtaaatctaaattccaacaattaaaccgaaatagttctttaaaaaagatgtttcgaaaccaatacgatagtgatgtgacagtgtggagcccccagggccgtctgcatcaggtagaatatgccatggaagcagttaacctaggttcagccacagtgggactgaaaagtaaaactcatgctgtacttatcgctttgaagagggcttcttcagaactgtctgcctaccagaagaaaattatcaacatagacgatcacattggtatcaccatctcgggacttacagctgatgctaggatccttagtagatatatgcgaaacgaatgcttgaattataagtactctttggatacttatatgccattgaataggcttatcagtattttaggtaacaaaatgcagacatgtacccaaagatacgaccgcagaccatttggtgtaggtcttctagtagctggttatgacgaatctggttctcatatctaccaaacgtgcccttctgctaatttctacgattgcaaagctatgtccattggagctcgatcccagagtgccaggacatacttagaaaaacatctggatgaattgccatctagttctttagaagaacttatcaaacatggattgagggctcttagagatactctacctccagaggttgacctcacaacaaaaaatgtctccataggatacactggcaaaggtcagacctttaaaatcctcgaagaagaagaaacttccccctacttgtcccttattgagggtgaagaacgtagaggaggaggagctgcagctgctgcaattgaggaccttcctgcagatccgttgagagatgatgcgggggacgagcccagggatgcagtcccagctgtggaaacttctgccatggataccacagaatagaaggattagataaagcattaaagccacccgttgatcaggagagtgggtattggaaaggaatattgccgtggctgtctctgttagtctaaaacagactgagacagtcacggcagaacatcgtttgttatatccatactgtattttttaagcttttaataatattttgattaataaat

SEQ ID NO: 169 - DNA, 558 bp, Diabrotica virgifera
  misc_feature (1)..(558): RNAi target sequence
tctgtgcaaaaacaaactgacaagtttgacataagtgacaagtgacatagcggttgtcaacaattttgcaagttgtgtaaattgttaatttgaaggaagcttttaacttttaagtaaaattaactgaaaatggctacagttttgtgtccagaaataccaacgcctggtttttcattcgaaaattgtaaaagaaatgcacttctggaaaataagggccttgctcttccaaaagccactaaaacaggtactacgatcgtaggaatagtctacaaagatggaattattcttggagcagatactagagctacagaagacaccacagttgcagataagaactgtgaaaagattcacttccttgcacccaatatgtattgttgtggtgctggtactgcagcagatacagaaatgaccactcagatggtctctgctaaattagaactccacagattatacacaaaccgagttactagagtgtgtacagcaaaccaattgttaaaacaatatctatttcgctaccagggatatattggggctgctttaatcctgggtggtgttgat

SEQ ID NO: 170 - DNA, 22 bp, Artificial Sequence
  primer
  misc_feature (1)..(22): forward primer
tctgtgcaaaaacaaactgaca

SEQ ID NO: 171 - DNA, 22 bp, Artificial Sequence
  primer
  misc_feature (1)..(22): reverse primer
atcaacaccacccaggattaaa

SEQ ID NO: 172 - DNA, 1578 bp, Diabrotica virgifera
  misc_feature (1)..(1578): WCRW transcript ta04816.001_diavv
gggggttttaaattttcgtagacacgattgttcagtagttcaaaattcattattattaatgttctgtgcaaaaacaaactgacaagtttgacataagtgagaagggacatagcggttgtcaacaattttgcaagttgtgtaaattgttaatttgaaggaagcttttaacttttaagtaaaattaactgaaaatggctacagttttgtgtccagaaataccaacgcctggtttttcattcgaaaattgtaaaagaaatgcacttctggaaaataagggccttgctcttccaaaagccactaaaacaggtactacgatcgtaggaatagtctacaaagatggaattattcttggagcagatactagagctacagaagacaccacagttgcagacaagaactgtgaaaagattcacttccttgcacccaatatgtattgttgtggtgctggtactgcagcagatacagaaatgaccactcagatggtctctgctaaattagaactccacagattatacacaaaccgagttactagagtgtgtacagcaaaccaattgttaaaacaatatctatttcgctaccagggatatattggggctgctttaatcctgggtggtgttgatattgaaggaccacatctatatatgatttatccacatggatccagtgttgatcttccttatgctacaatgggttctggttccttagcagccatatctgtctttgaatcccgctggaagcctcaaatggaagaggaagatggtgtccaactagtaagagatgctattgcagctggtatattcaatgatctaggttcaggttccaatgtagacatctgtgtaataagaaagggttcagtagactacaaacgaacctatgacgaggctaacaaaaagggagttaaacaaggatcttatagatatcaaagaggaaccactgcagtgctcagtacccaggtggtggatgttgaggaagtctcagtgattcccattgaagctgaagaaatggatgttgcttaaatattacagttaaataaatgtcattgtattctttttggtatttactttaatataaaaataaaaaataaatataacagggtttaaatgttcaataatatagtaaattttaatttaaaaaaatattttttcttaacaattacaatagccacatctaaatagatttgctactcaaggatgttgagttaataggatcagtcagtctataaaactaaagaacacatttattttgatcattactttgggtttgatagctgccctttattatatgttaattttaagtacaatctatataaccctaaagttgtttacccaaaaatcatttttatcattttcgagagtaaatattgttcaattttcacatgtcaaaaatattattatattttttactgtgtttaatcttttattacaacccttaaggtactagtacacttcagaagaacaaaaataatcatttttttaaagaattttcctctcagaacctgtattaaaaatgaacacaaaacctgtcacatactaatatctaactctcagagagtacaagaaatatatctcttttcattca

SEQ ID NO: 173 - DNA, 473 bp, Diabrotica virgifera
  misc_feature (1)..(473): RNAi target sequence
aatataccgaaaatgccgagtcaagaattaacaactaataaagtaatagtccaccctttggttcttctaagtgtggtggaccattttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaagatttaggtttaccaactgaagcttatcaagctgtagaagaagtacacgatgacggttcacctac

SEQ ID NO: 174 - DNA, 22 bp, Artificial Sequence
  primer
  misc_feature (1)..(22): forward primer
aatataccgaaaatgccgagtc

SEQ ID NO: 175 - DNA, 22 bp, Artificial Sequence
  primer
  misc_feature (1)..(22): reverse primer
gtaggtgaaccgtcatcgtgta

SEQ ID NO: 176 - DNA, 1221 bp, Diabrotica virgifera
  misc_feature (1)..(1221): WCRW transcript ta03894.001_diavv
tagttaattgggaacaaagattttattagaataatataccgaaaatgccgagtcaagaattaacaactaataaagtaatagtccaccctttggttcttctaagtgtggtggaccattttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaagatttaggtttaccaactgaagcttatcaagctgtagaagaagtacacgatgacggttcacctacatctaaaacatttgagcatgttcctagtgaaatcggagctgaggaagctgaagaagttggtgttgaacacttattgagagatattaaagacacaactgttggtactttgtcacagagaataacgaatcagcttttagggttaaaaggtctccattcacagttacgtgatattagggactatttggtacaagtgtgtggtaaccagcttccaatcaatcaccaaatcatctaccaattacaagacatatttaatcttttgcccgatataaatcaggatgcatttaatacatcgttttacgtgaaaaataacgatcaaatgttagtcgtttatctagcagctttagttagatctattgtcgctctacacaatcttattaacaacaaactaacaaatagagacgcggaagaaggaaaaaaggaggatagtaagaaagaaagcaaagataaggacaaggataaagagaaggaaaaggataaagatgctaagaaggacgagaagaaaaagtaattgtgtattatatctggttctacattcaaatgttctcatgttgtgttttcaaacacgatattttaatggtttcaacactttccatttgattcgagtataataatttattttcattttatatgctagtttagtatatacctaacttccttactaagtttgatttatatttaggcaataaagttctttatacaaaaaaaaaaaaaaaaaa

SEQ ID NO: 177 - DNA, 553 bp, Diabrotica virgifera
  misc_feature (1)..(553): RNAi target sequence
ttaattctgctgctcctcctttgtggcataacggccccgtacctggagaattttacaattttcccggcaaacagaccagctattccaaccctataacacatacacagtctcccgttacaacatcaacttctgtattagctattacttacgataaaggagtattgatagccggagatctggttgcttcatacggatctttagctaggtacggaaattgcccgagggttattaaagtcaatcagaatatcatcttgggagccggaggagactatgctgatttccaatacgtcaagagtttcattgagcaaaaaataattgatgaagaatgcattgatgatggactaaaaatgaaaccaaaatcattgtactgctggcttactagagtaatgtaccaacgcaggagtaaattagaccctttttggaataatctggttataggaggaatccaggatggagtcccctttcttggaaccgtagataaattgggaactgcatatacagacaaagttatatgtacaggttatggagcccacatagccttgcctcttctgag

SEQ ID NO: 178 - DNA, 22 bp, Artificial Sequence
  primer
  misc_feature (1)..(22): forward primer
ttaattctgctgctcctccttt

SEQ ID NO: 179 - DNA, 22 bp, Artificial Sequence
  primer
  misc_feature (1)..(22): reverse primer
ctcagaagaggcaaggctatgt

SEQ ID NO: 180 - DNA, 925 bp, Diabrotica virgifera
  misc_feature (1)..(925): WCRW transcript ta01874.001_diavv
aaacaagtcatcgttgaattttctgaagttagagattctttgattacagtttgttgtattaaatagaaaatgtttaattctgctgctcctcctttgtggcataacggccccgtacctggagaattttacaattttcccggcaaacagaccagctattccaaccctataacacatacacagtctcccgttacaacatcaacttctgtattagctattacttacgataaaggagtattgatagccggagatctggttgcttcatacggatctttagctaggtacagaaattgcccgagggttattaaagtcaatcagaatatcatcttgggagccggaggagactatgctgatttccaatacgtcaagagtttcattgagcaaaaaataattgatgaagaatgcattgatgatggactaaaaatgaaaccaaaatcattgtactgctggcttactagagtaatgtaccaacgcaggagtaaattagaccctttttggaataatctggttataggaggaatccaggatggagtcccctttcttggaaccgtagataaattgggaactgcatatacagacaaagttatatgtacaggttatggagcccacatagccttgcctcttctgagagactctttagataaaaatggagctcttaacttggccgatgccaaaactctgattcacaaatgcatggaagtattgttctatagagatgccagaagttttcctaaatatcagcttggtgttattgataaagatgatggtgttagtattgaggggcctatttcagtcgaagagaactggagcattgcccatatgacataatttttcttaatttcgtttattttgtattgaaactatattatacattcatggaagtctgtgtgaataaatttttgataaaactaaaaaaaaaaaaaaaaaa

SEQ ID NO: 181 - DNA, 420 bp, Diabrotica virgifera
  misc_feature (1)..(420): RNAi target sequence
acaagcaatggcgaaagtaaatgaagtggctaatttgtacaagcagttaaaatcagaatggaataccaacaacccaaatttaagtaaatgtgaaaaactactctcaactcttaagcttgagctcaccaatctaatgtttctgccgattaccacatctactgcgtccaaacaagaactacttctagccagagatgttctagagataggagtccaatggagtatagcagccaatgatattacatcttttgaaagatacatggcacaattaaaatgttattacttcgattataacaaccaactaccagaatcaccatttaagtaccaactgcttggattaaacttgttattcctgctgtcacaaaaccgagtagcagaatttcacactgaattggaacttttacctgccgatcatattcagaa

SEQ ID NO: 182 - DNA, 22 bp, Artificial Sequence
  primer
  misc_feature (1)..(22): forward primer
acaagcaatggcgaaagtaaat

SEQ ID NO: 183 - DNA, 22 bp, Artificial Sequence
  primer
  misc_feature (1)..(22)
ttctgaatatgatcggcaggta

SEQ ID NO: 184 - DNA, 1040 bp, Diabrotica virgifera
  misc_feature (1)..(1040): WCRW transcript ta06150.001_diavv
gacagctgtcacaaatattcaacggattccatttgttcctagtcatagtgtaatttgtggaagaattttgttcgagtatttatagctaaaattctgaagatttaattaattaaacaagcaatggcgaaagtaaatgaagtggctaatttgtacaagcagttaaaatcagaatggaataccaacaacccaaatttaagtaaatgtgaaaaactactctcaactcttaagcttgagctcaccaatctaatgtttctgccgattaccacatctactgcgtccaaacaagaactacttctagccagagatgttctagagataggagtccaatggagtatagcagccaatgatattacatcttttgaaagatacatggcacaattaaaatgttattacttcgattataacaaccaactaccagaatcaccatttaagtaccaactgcttggattaaacttgttattcctgctgtcacaaaaccgagtagcagaatttcacactgaattggaacttttacctgccgatcatattcagaatgatgtgtacatcagacatcccttgtctattgaacaatatttaatggaagggagttataataaaatatttctggctaaaggtaatgtacctgctaagagttataacttctttatggatattttgctggacaccataagagaagaaattgcagactgtttatcagtagcctatgaaaagatctcagtaaaagacgtagccagaatgctgtacctgccaaacgaagaagctgctaaaacatttgccaaaaaggctttccagctcaaaccgtggaagctcaacaatgactttttccactttcttcctgaagagaagacccacgaacccataccctcacaggaactggcacagcaggctatagagtatgccaaggaacttgaaatgattgtctaataggtgtatttaattcttatatttaggatttttttatataaaaatcaatatttaataaacaaacaatttatttgttttgtactttaaaaaaaaaaaaaaaaaaaaaaaaaaatgcg

SEQ ID NO: 185 - DNA, 716 bp, Diabrotica virgifera
  misc_feature (1)..(716): RNAi target sequence
  misc_feature (608)..(608): n can be any nucleotide
  misc_feature (645)..(645): n can be any nucleotide
cattacatagcgctttttgttattgcaaattgtcggcccgagttattttgtacaatggagtgtctacttggtatcaaatttaatgattacgttcttgttgctgcagatatgactgcagcgcaaagcataattgtaatgaaaacagatgaaaacaagcttcataaactttccaataagcttgttatggctgtttctggtgagtctggggatactacacagtttgcagagtatatagcaaaaaatattcaactttacaaaatgaggaatacctatgaattgagtcccaaagaagctgcagcatttactagaagaaatttggcagatgcactcagaagcagaagtgcataccatgtaaaccttcttctagctggatatgatgacaaagaaggtcctcagctatattacatggactacctagcatccatagcaagcgttgattatgctgctcatggttatggaggattcttttcactgtcaattatggatcgtaattatcggcagaaccttagtaaagaagaaggttatgaacttttgaaaaaatgtgtgaaagaagttcagaaaagattgatcatcaatttgcctaactttaaggtgcagtgtgttgatanaaatggcatccaggatatgcctaatatcactgctaangatttggtttaatttagtttgatataagttatgtatttttttttattattaaataaactgaattttcttgt

SEQ ID NO: 186 - DNA, 20 bp, Artificial Sequence
  primer
  misc_feature (1)..(20): forward primer
cattacatagcgctttttgt

SEQ ID NO: 187 - DNA, 20 bp, Artificial Sequence
  primer
  misc_feature (1)..(20): reverse primer
acaagaaaattcagtttatt

SEQ ID NO: 188 - DNA, 872 bp, Diabrotica virgifera
  misc_feature (1)..(872): WCRW transcript ta01941.001_diavv
aaaaatggggggctatcattacatagcgctttttgttattgcaaattgtcggcccgagttattttgtacaatggagtgtctacttggtatcaaatttaatgactacgttcttgttgctgcagatatgactgcagcgcaaagcataattgtaatgaaaacagatgaaaacaagcttcataaactttccaataagcttgttatggctgtttctggtgagtctggggatactacacagtttgcagagtatatagcaaaaaatattcaactttacaaaatgaggaatacctatgaattgagtcccaaagaagctgcagcatttactagaagaaatttggcagatgcactcagaagcagaagtgcataccatgtaaaccttcttctagctggatatgatgacaaagaaggtcctcagctatattacatggactacctagcatccatagcaagcgttgattatgctgctcatggttatggaggattcttttcactgtcaattatggatcgtaattatcggcagaaccttagtaaagaagaaggttacgaacttttgaaaaaatgtgtgaaagaagttcagaaaagattgatcatcaatttgcctaactttaaggtgcagtgtgttgataaaaatggcatccaggatatgcctaatatcactgctaaggatttggtttaatttagtttgatataagttatgtatttttttattattaaataaactgaattttcttgtaaaaaaaaaaaaaaaagtagcatttatttctatattaggacaagaaattagatagggtggtatatgcttgtaacaaaatttactaattatacggtaaacgccaccctactagatacataggaacattgagctattacagtcc

SEQ ID NO: 189 - DNA, 364 bp, Diabrotica virgifera
  misc_feature (1)..(364): RNAi target sequence
  misc_feature (274)..(274): n can be any nucleotide
ttggcatgactgtgcaaatagtcggtccattgtgcatgagtaaagtgattctaaccataacttcaaaacgctttagttttaaatatttgtgaacattaataacagaaacagttcattcaaaataatctataagaatgggcgatacaaaggtagaacctacaaaggtggataaaacaaaggggactgaggacaaaaacaaaaatgaactgtcggaagaagacaaacagcttcaagatgaattaaatttgtgtgttgagaaactccaaggataacnatgaaaagagatacctacttgctttgcaaagctttatcaaatcatattcaaagcctcaactacttcgatgacttctgttcctaaagccgt

SEQ ID NO: 190 - DNA, 22 bp, Artificial Sequence
  primer
  misc_feature (1)..(22): forward primer
ttggcatgactgtgcaaatagt

SEQ ID NO: 191 - DNA, 22 bp, Artificial Sequence
  primer
  misc_feature (1)..(22): reverse primer
acggctttaggaacagaagtca

SEQ ID NO: 192 - DNA, 3066 bp, Diabrotica virgifera
  misc_feature (1)..(3066): WCRW transcript ta44362.001_diavv
attgaatgcttggcatgactgtgcaaatagtcggtccattgtgcatgagtaaagtgattctaaccataacttcaaaacgctttagttttaaatatttgtgaacattaataacagaaacagttcattcaaaataatctataagaatgggcgatacaaaggtagaacctacaaaggggactgaggacaaaaacaaaaatgaactgtcggaagaagacaaacagcttcaagatgaattaaatttgtgtgttgagaaactccaggataacgatgaaaagagatacctacttgctttgcaagctttatcaaatcatattcaagcctcaactacttcgatgacttctgttcctaagccgttaaaatttatgaggccccattacgaaaccatgaagacagtacatgaaaaaattactgatcctgatactaaaaaagtctgtgcagatattatatctgttttagctatgacaatgggagaaggcagagaatgtttgaaataccgtcttctttctaatttggataaaattggcgaatggggacatgaatatgttaggcatttggcaggagagattgcaggagaatgggccgagactgattttatagtgaacactgaaattagggaaaaacttatcttactaacaaaacaaattgtgccatataatatggcacacaatgcagaagcagaagcatgtgacttgcttatggaaattgaaaggcttgatctactagaacagtatgttgatgaaaacatctaccatagagtgtgcttatatctcaccagctgtgtaccctatgtggcagatcctgagaatactactctactgcagactgctcttttactgtttagaaagtttgatcagtatccccaggcactgagattagcaatgcagttaaatgactttggattaattgaagaaatttttgtcaactgcccagattcggacgtacaaaaacaactggcatttatgctaggacgacaacagatatatgttgaaattcctgagcatacgcctgaatacgaagatctaatcgagataatggcaaactgtcatcttaataaccacttcttgaacctcgctcgcgagttggacattatggatcctaaaacccccgaagacgtttacaaatcccatttagaaaatagtcgtcctccatttggtggaaaccaagttgattcagccagacaaaacttagctgccagctttgttaacggttttgttaatgctgcttttggtcaagataagctcttaatggaagatgggaataaatggctttacaaaaacaaagaacatggaatgcttagtgctactgcttctttgggactaattcttttatgggatgtagacggtggtcttactcctatcgataaatacttgtactcttctgaagaccatatcaagtctggcgctttattagcttgtggcattgtaaactgcggtgtcaggaatgaatgtgatcccgcacttgcacttttaagtgattatgttcttcacaacacaaacataatgagaataggagctattgtaggtctaggtttagcgtatgttggttcaaatagggaagcagtattatctctaatcacgcctgtgctatctgaccctaaatcaaatatggaggtcattggaatggcggctctagcatgcggaatgatttctgcaggatctggtaactcacatgtgacaacatcaataatgcaagttcttatggaaaagtccgaaatagaattaaaggacacttacgccagatttttgcctctgggtcttggattgtgtcatttaggtaaacaagaaagcattgacacaattatagcagcattagaagttatacctgaccctttcagatccatggcgactactatggtcgatatttgcgcttatgcaggcacaggaaatgttttaaaagtacaacatttgttacatatatgttcagaacattacgatgctcctgaaactcctgacaaaacttcaaaggacaaagataaaaaagaagcagagaaagaaaaagataaggatctttcagctagacaagctattgcggttttgggtatagctttaattagcatgggagaagacattggtagcgagatggctttccggacatttggtcatttactaagatactgcgaaccagcgatcagacgtgctgttcccttagccctaggcttaatctcagtttcaaatccaaaattaagtattctcgatactttgagtaaattttcacatgatagcgatgctgaagtggctcataatgccatctttgcgatgggtctggtgggagctggtactaacaatgcaaggttagcagctatgctaagacagttagcacagtaccatgccaaagatcccaataatttatttatggttcgcatcgcccagggtctcactcatcttggcaaaggaactttaactctcagtccattccacagtgataggcagctgatgagtccagtagctgtagctggtctaatggcgacactcatcggcttcttggatgttaaaaacattatattggggaagtcacactacttactgtacaccttagcagctgcaatgcaaccaaggatgttagtcacatttgacgatgagctaaatcctctaccagtgcctgtcagagttggattggcagtggatgttgttggccaagcaggaaaaccaaagactataacaggtttccaaacccataccactcctgtgcttctggcttatggtgagcgcgctgagctcgcaactgaagaatacattgcattgacgccaattatggaaggatttgttattttacgaaaaaatcctgaatttaattcataaatatattatttccgtcattgtttatcatgttccgcaattttttgatttaatatacttttttgtattaatcgatatttattaaatattgctcacgttttgattgaaaaccctaattgttcataacctcttcaatatctgtatatttgcattgaaaatatctgaatctgtatattttaagaaaaaatcgcgaatttaattcataaatatagataaaagtatagggacaaaattatggagcccatttctctaaagtggacgattttggaga

SEQ ID NO: 193 - DNA, 358 bp, Diabrotica virgifera
  misc_feature (1)..(358): RNAi target sequence
  misc_feature (267)..(267): n can be any nucleotide
cagcagtggtacagcaatcaaatgtaaacgattatttactaaaaaaacaacaagaaagtactaaagaattaggctcagaatgggccgaacttgaagaacttcataataaaaaattgtggcatcagttgactctaaaattgctgaattttattaagaaaccagaactacagaagaatgataacctcattcaactgtacaataactttattcaaagttttgaaaataaaatcaatcctttgtcattggttgaaattgttgctatagtantccaacaattcaaaaatccaaaagatgctgtcgcttttcttgaaaagactgaacctaaggttaaaattaattcaagatgcccaaaacttgt

SEQ ID NO: 194 - DNA, 21 bp, Artificial Sequence
  primer
  misc_feature (1)..(21): forward primer
cagcagtggtacagcaatcaa

SEQ ID NO: 195 - DNA, 21 bp, Artificial Sequence
  primer
  misc_feature (1)..(21): reverse primer
acaagttttgggcatcttgaa

SEQ ID NO: 196 - DNA, 1241 bp, Diabrotica virgifera
  misc_feature (1)..(1241): WCRW transcript ta04679.001_diavv
taaaagcgaaaatggctgcagcagtggtacagcaatcaaatgtaaacgattatttactaaaaaaacaacaagaaagtcctaaagaattaggctcagaatgggccgaacttgaagaacttcataataaaaaattgtggcatcagttgactctaaaattgctgaattttattaagaaaccagaactacagaagaatgataacctcatacaactgtacaataactttattcaaagttttgaaaataaaatcaatcctttgtcattggttgaaattgttgctatagtagtccaacaattcaaaaatccaaaagatgctgtcgcttttcttgaaaagactgaacctaaggttaaaattaattcagatgcccaaaacttgtgcaaagttttagctgggcagatatatatcgaaaagttgaacgatttagatgctactaaaaagataattgaagaagtggaatctacattggacaatgctgatggtgttactccagttcatggaagattttatttacttgcctcacaatattatagaattcaaggaaaccatgctcaatattataggacagcattgagatatcttggatgcatagagttggatacaataacatcagaagtgaaagtgcaacacgctttctttttgggtttggctgctctattaggcgaaggtgtctataacttaggtgaattactcgcacatcccgttttggagtccctaaaatcaacagaaaatgcgtggttggtagaattgttgtatgcttttaattctggcaatattaaaaagtttgagtccatgaaaccgcagtgggaagctatagcagatcttgcagctgaagaattatttttacgacaaaaaatatccctgttgtgtcttatggagatgacatttaatagaccatcgcacaacaggcaattaacatttgcagaaatcgcaaaagaaacaaaattacctttgaatgaaattgaattattgattatgaaagcgttgtcccaaggactagtcaaaggagccattgatcaggttgccaataccgtaaatatgacctgggttcaacctagagttttggattgtacgcagatttccaacatgattactaggcttaacgattggtgtaaacatgttgataccatggagcaattgctggaagaaaaagctagtgaaatattaacattgtaatttgtaattattaataatttatatattcgtccttaatttttttttaaggttttctcactgataataaaa

SEQ ID NO: 197 - DNA, 410 bp, Diabrotica virgifera
  misc_feature (1)..(410): RNAi target sequence
tggaggtgataacgaggtacaacgtactatgttagaacttatcaatcagttggatggttttgatcctagaggtaacattaaagtacttatggctacaaatcgtccagatactctagatcctgcccttatgagacctggtcgtttggatcgtaaagttgaatttggacttccagaccttgaaggaagaactcatattttcaaaattcatgctaggtccatgtctgttgaaagagatattcgttttgaacttttggctaggttgtgtccaaattccactggagctgaaatcagaagtgtttgtaccgaagctggtatgttcgctataagagcaaggaggaaagtagctaccgaaaaagacttcttagaagctgtaaataaagtaattaagtcatacgccaagttctctgcta

SEQ ID NO: 198 - DNA, 22 bp, Artificial Sequence
  primer
  misc_feature (1)..(22): forward primer
tggaggtgataacgaggtacaa

SEQ ID NO: 199 - DNA, 22 bp, Artificial Sequence
  primer
  misc_feature (1)..(22): reverse primer
tagcagagaacttggcgtatga

SEQ ID NO: 200 - DNA, 1452 bp, Diabrotica virgifera
  misc_feature (1)..(1452): WCRW transcript ta07921.001_diavv
ttatttaaaactaaatctatgaaaaatattgttcttaaaatatttttcatagatttagttttaaataaagacaattaagatgccggaccatttaggagatgatatgcgaaaaataaaagaacagaaagaggagcccgaaaaggaaattaaagccctggatgaaggtgatatagcacttcttaaaacctatggacaagggcaatacacaaagacaattaaaacatgtgaagaagatatccaaacgataatcaaaagagtaaatgaattaactggtataaaagaatctgatactggtttagctccaccagctttatgggatttggcagctgacaaacaaaccttacaaaatgagcaacccttacaagtggcccgttgtacgaaaattatcaacgctgatacagatgatcccaaatacattataaacgttaaacagtttgccaaattcgtagtagatttggcagactctgtggcccctacagacatagaagaaggcatgagagttggagtcgaccgaaataagtatcaaattcatattcctctacctccaaaaattgatcccactgtgactatgatgcaagttgaggagaagcctgatgttacatacagtgatgttggtggctgcaaggaacaaattgaaaagttgagagaagttgttgaaacacctttactccatcctgaaaaatttgtaaaacttggtattgaaccaccaaaaggcgttctcctttttggcccccctggaactggtaaaactctttgtgctagagcagtagccaatagaacagatgcctgctttattcgtgtaattggttctgaactggttcagaagtacgtaggagagggagcaagaatggttagagaacttttcgaaatggctaggtctaagaaggcctgcttgatattctttgatgaaattgatgccattggtggagccagatttgatgatggcgctggaggtgataacgaggtacaacgtactatgttagaacttatcaatcagttggatggttttgatcctagaggtaacattaaagtacttatggctacaaatcgtccagatactctagatcctgcccttatgagacctggtcgtttggatcgtaaagttgaatttggacttccagaccttgaaggaagaactcatattttcaaaattcatgctaggtccatgtctgttgaaagagatattcgttttgaacttttggctaggttgtgtccaaattccactggagctgaaatcagaagtgtttgtaccgaagctggtatgttcgctataagagcaaggaggaaagtagctaccgaaaaagacttcttagaagctgtaaataaagtaattaagtcatacgccaagttctctgctacaccaagatatatgacttacaattaattttaaagattttctaattatcgaattatttaaattgcgtttctaaataaataatccttttttagtgt

SEQ ID NO: 201 - DNA, 458 bp, Diabrotica virgifera
  misc_feature (1)..(458): RNAi target sequence
tctcctgaagggaggttgtatcaggtggagtatgccatggaggctatttctcatgcaggtacttgtctgggcattttagcaaatgatggaattttgttggctgctgagaggcgtaacactaacaaattattagatgaagtttttatttcagaaaaaatatacaaactaaatgatgatatggtttgtagtgtggctggaataacatcagatgctaatgttttaacaaatgaattgagacttataggtcaaagatatttatttcagtatgccgaatctattccttgcgaacagttagtttcctggctttgtgatgtcaagcaggcatacactcagtatggaggtaaacgtccatttggtgtttcaatattatatatgggatgggataaacattatggataccagctatatcagtcagatcccagtggcaactattctggttggaaagctacctgcatagg

SEQ ID NO: 202 - DNA, 22 bp, Artificial Sequence
  primer
  misc_feature (1)..(22): forward primer
tctcctgaagggaggttgtatc

SEQ ID NO: 203 - DNA, 22 bp, Artificial Sequence
  primer
  misc_feature (1)..(22): reverse primer
cctatgcaggtagctttccaac

SEQ ID NO: 204 - DNA, 892 bp, Diabrotica virgifera
  misc_feature (1)..(892): WCRW transcript ta04612.001_diavv
tttaaattttctaggctcagtatttttagctatattgagtatcaactaaaactatggctcgtcgatatgataccagaaccacaatattctctcctgaagggaggttgtatcaggtggagtatgccatggaggctatttctcatgcaggtacttgtctgggcattttagcaaatgatggaattttgttggctgctgagaggcgtaacactaacaaattattagatgaagtttttatttcagaaaaaatatacaaactaaatgatgatatggtttgtagtgtggctggaataacatcagatgctaatgttttaacaaatgaattgagacttataggtcaaagatatttatttcagtatgccgaatctattccttgcgaacagttagtttcctggctttgtgatgtcaagcaggcatacactcagtatggaggtaaacgtccatttggtgtttcaatattatatatgggatgggataagcattatggataccagctatatcagtcagatcccagtggcaactattctggttggaaagctacctgcataggcaacaacagttcagcagcaatttcaagtttgaaacaagaatataaagaaggtcaaatgactttgaaggatgcaaagacgttagcagtaaaggttctggcaaaaacattggatatggcaaaactaacttcagaaaaagtggaaatggctacacttacccgcaaaaatgataaaaccatgattaaaattttaagcggcaaggaagtagaagaactgatttcagagtatgaaaaaagtgaagctgccgcagaagctagcaaaaaagagcagaaggcatcagcttaattacatttatttggttttgtttaggttcactaagtatgtcattgtcacaatatgaataaatg

SEQ ID NO: 205 - DNA, 453 bp, Diabrotica virgifera
  misc_feature (1)..(453): RNAi target sequence
tgcagcttatagtggctgaaaagagtcaaaatcttagacgtttgcaagctcagagaaatgaactcaatgccaaagttcgtatgttgagagaagaactgatgttacttcaagagcaaggaagctatgtcggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaatacttccaaacaaggttgatcctttagtttccttgatgatggtggagaaagtccctgattcaacttatgaaatggtaggaggacttgacaagcaaattaaagaaatcaaagaagtaattgaacttccagttaaacatccagaactttttgatgctcttggtattgcac

SEQ ID NO: 206 - DNA, 22 bp, Artificial Sequence
  primer
  misc_feature (1)..(22): forward primer
tgcagcttatagtggctgaaaa

SEQ ID NO: 207 - DNA, 22 bp, Artificial Sequence
  primer
  misc_feature (1)..(22): reverse primer
gtgcaataccaagagcatcaaa

SEQ ID NO: 208 - DNA, 1322 bp, Diabrotica virgifera
  misc_feature (1)..(1322): WCRW transcript ta01297.001_diavv
aaactcccggagtgcaaaaaactatcaagaatgacggtaattaacaagatggaggtggacggaggtccgaagggagaaggttttcggtcatattatattacaaagattgaagaattgcagcttatagtggccgaaaagagtcaaaatcttagacgtttgcaagctcagagaaatgaactcaatgccaaagttcgtatgttgagagaagaactgatgttacttcaagagcaaggaagctatgtcggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaatacttccaaacaaggttgatcctttagtttccttgatgatggtggagaaagtccctgattcaacttatgaaatggtaggaggacttgacaagcaaattaaagaaatcaaagaagtaattgaacttccagttaaacatccagaactttttgatgctcttggtattgcacaacctaagggtgtgttgttatatggaccaccaggcactggaaaaactcttctggcacgtgctgtagctcatcacacagagtgtacatttattagagtatctggttcagaattggtacagaaattcataggagaaggatcccgtatggtaagagaactcttcgtaatggccagagaacatgctccttcaattattttcatggatgaaattgattccattggatcttcccgtattgaatcaggatctggtggtgattctgaagtccaaagaaccatgttggaacttctaaatcaattggatggttttgaagctaccaaaaacatcaaagtaattatggctaccaacagaattgatattttggatcccgctttactcagaccaggaagaattgacagaaaaattgaattccccccaccgaacgaagaagctagattggacatcttaaagattcactccagaaaaatgaacctcacaagaggaataaatctgagaaaaatagctgagttgatgccaggtgctagtggagctgaagttaagggtgtgtgtacggaagctggtatgtatgcactaagagaacgaagggtgcatgttactcaagaagattttgaaatggccgtcgccaaagttatgcagaaggattctgagaagaatatgtccatcaagaagttgtggaaataagttttttgtactacttaatatgtgattattttttaagaaataaaatatagcgaatagataaaaaaaaaaaaaaaaaa

SEQ ID NO: 209 - DNA, 488 bp, Diabrotica virgifera
  misc_feature (1)..(488): RNAi target sequence
gttaagatgccggaccatttaggagatgatatgcgaaaaataaaagaacagaaagaggagcccgaaaaggaaattaaagccctggatgaaggtgatatagcacttcttaaaacctatggacaagggcaatacacaaagacaattaaaacatgtgaagaagatatccaaacgataatcaaaagagtaaatgaattaactggtataaaagaatctgatactggtttagctccaccagctttatgggatttggcagctgacaaacaaaccttacaaaatgagcaacccttacaagtggcccgttgtacgaaaattatcaatgctgatacagatgatcccaaatacattataaacgttaaacagtttgccaaattcgtagtagatttggcagactctgtggcccctactgacatagaagaaggcatgagagttggagtcgaccgaaataagtatcaaattcatattcctctacctccaaaaattgatcccac

SEQ ID NO: 210 - DNA, 22 bp, Artificial Sequence
  primer
gttaagatgccggaccatttag

SEQ ID NO: 211 - DNA, 22 bp, Artificial Sequence
  primer
  misc_feature (1)..(22): reverse primer
gtgggatcaatttttggaggta

SEQ ID NO: 212 - DNA, 1425 bp, Diabrotica virgifera
  misc_feature (1)..(1425): WCRW transcript 454run3_isotig16670
aaaatttgcttgtaatcttgcacaaaaatattttaagaacaatatttttcatagatttagttttaaataaagacaattaagatgccggaccatttaggagatgatatgcgaaaaataaaagaacagaaagaggagcccgaaaaggaaattaaagccctggatgaaggtgatatagcacttcttaaaacctatggacaagggcaatacacaaagacaattaaaacatgtgaagaagatatccaaacgataatcaaaagagtaaatgaattaactggtataaaagaatctgatactggtttagctccaccagctttatgggatttggcagctgacaaacaaaccttacaaaatgagcaacccttacaagtggcccgttgtacgaaaattatcaacgctgatacagatgatcccaaatacattataaacgttaaacagtttgccaaattcgtagtagatttggcagactctgtggcccctacagacatagaagaaggcatgagagttggagtcgaccgaaataagtatcaaattcatattcctctacctccaaaaattgatcccactgtgactatgatgcaagttgaggagaagcctgatgttacatacagtgatgttggtggctgcaaggaacaaattgaaaagttgagagaagttgttgaaacacctttactccatcctgaaaaatttgtaaaacttggtattgaaccaccaaaaggcgttctcctttttggcccccctggaactggtaaaactctttgtgctagagcagtagccaatagaacagatgcctgctttattcgtgtaattggttctgaactggttcagaagtacgtaggagagggagcaagaatggttagagaacttttcgaaatggctaggtctaagaaggcctgcttgatattctttgatgaaattgatgccattggtggagccagatttgatgatggcgctggaggtgataacgaggtacaacgtactatgttagaacttatcaatcagttggatggttttgatcctagaggtaacattaaagtacttatggctacaaatcgtccagatactctagatcctgcccttatgagacctggtcgtttggatcgtaaagttgaatttggacttccagaccttgaaggaagaactcatattttcaaaattcatgctaggtccatgtctgttgaaagagatattcgttttgaacttttggctaggttgtgtccaaattccactggagctgaaatcagaagtgtttgtaccgaagctggtatgttcgctataagagcaaggaggaaagtagctaccgaaaaagacttcttagaagctgtaaataaagtaattaagtcatacgccaagttctctgctacaccaagatatatgacttacaattaattttaaagattttctaattatcgaattatttaaattgcg

SEQ ID NO: 213 - DNA, 553 bp, Diabrotica virgifera
  misc_feature (1)..(553): RNAi target sequence
  misc_feature (485)..(485): n can be any nucleotide
caaaggaactcgcagagcttataaaggccaccaggccttttttgagtttaataagcaaagcaaaagctgctaaattggtaaggtctctagttgactacttcctagatttagaagctggtattggtatcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaatttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaagganttcaaaacagcttattcttatttttatgaagcttttgaaggttttgatagtgttgaatccccaaaagc

SEQ ID NO: 214 - DNA, 22 bp, Artificial Sequence
  primer
  misc_feature (1)..(22): forward primer
caaaggaactcgcagagcttat

SEQ ID NO: 215 - DNA, 22 bp, Artificial Sequence
  primer
  misc_feature (1)..(22): reverse primer
gcttttggggattcaacactat

SEQ ID NO: 216 - DNA, 1860 bp, Diabrotica virgifera
  misc_feature (1)..(1860): WCRW transcript ta03917.001_diavv
gggtcagatccgatcatattaacgtgaaaagcatatttatgacagacaaattaatggaagtttagtagtgagtagtgaaaaaatatggccggagcaatgttatttgaaagagccccgtctgtttcttctcaacacgagaagcttttaaaattatccagggattcagatgatgaagatcaaaatattgtcaataaagaacaagacatccttaatcttggtgagaaatataaaaaggagggcaaggcaaaggaactcgcagagcttataaaggccaccaggccttttttgagtttaataagcaaagcaaaagctgctaaattggtaaggtctctagttgactacttcctagatttagaagctggtattggtatcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaatttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttatgaagcttttgaaggttttgatagtgttgaatccccaaaagccctcacagcccttaaatacatgcttttgtcaaaaatcatgataaacagtccggaagacgtccaacaaatcgttagtggtaaattggcctttaaatacgctggtcaagatatagaggctatgaaatcagttgcacaggctgcacacaaaagatcactagcagatttccaacaagctgtaaaacagtttaaacatgaattagaagatgatgttattgttagagcacatttaggaacgttgtatgacaatatgttggagcagaacctttgcagaattatcgaaccatattctagggtacaagtagagtatgtagcaaaaaccataaaactcccagtactacaagtagagaagaaattgtcacagatgattttagatgccaagtttcatggaattttggaccaaggcgaaggtgtcctcatagtattcgaagaaagtgcagtagacaaaacatatgaaatggccctagaaacgatccagagtatgagcaaagtagtagatactctttatcaaaaagcaaagaaattgtcataggtataatgtagccgagaatgttatgaaaataataaaatgactgtaaatttttcagaactagattttttgtagacactgtgtttatataacctatttaatttgcttttgttaattcttgtctttttaaggattcttataactcatagttttcggagcttgagggttttggatgtgatggagtttttttgttaatacagtatagatattttttaagatacttaaagcttatctaaatctaggaaaatatcatgcctaaagtcataagagattcataatccatatgtaactaactcatagaactattttctttataatattttttacaagcaatgaaataaaagcctcaaaaaatagactgaactttagagactttaggcattgagttttggtctttattgggaaaatattaatacaaaagttctataagaaatatctttgtatggtttattaattcattttttaacctgccaagacattgtgatctctattactatcagtgtcattggcttgttttcatacaatttttccctaata

SEQ ID NO: 217 - DNA, 469 bp, Diabrotica virgifera
  misc_feature (1)..(469): RNAi target sequence
  misc_feature (294)..(294): n can be any nucleotide
  misc_feature (295)..(295): n can be any nucleotide
  misc_feature (296)..(296): n can be any nucleotide
  misc_feature (385)..(385): n can be any nucleotide
  misc_feature (386)..(386): n can be any nucleotide
gtcaataccttttcacccgaaggaagattatttcaagtacaatatgccatacaagctattaagttaggatctaccgctattggaatatgcaccagtggtggagtagtgcttgctgtacaaaaacgcattacttccccattaatggaacctactacgattgagaaaattgtagaagttgacaaacatattggatgtgcggtttcaggacttatggcagattcaaggactatgatagatagagctcgtgtggaatgtcacaatcattggtttgtctacaatgaaaatataagtgtnnnatcctgtgcacaaggtgtatcaaatttggctattcagttcggatattctgatgaagatggtgcagccatgtctagaccttttggagtannaattttgtttgctggtatagatgaaaaaggacctcagttgtaccatatggatccatcaagaacatttgttcagtttgacgcaa

SEQ ID NO: 218 - DNA, 22 bp, Artificial Sequence
  primer
  misc_feature (1)..(22): forward primer
gtcaataccttttcacccgaag

SEQ ID NO: 219 - DNA, 21 bp, Artificial Sequence
  primer
  misc_feature (1)..(21): reverse primer
ttgcgtcaaactgaacaaatg

SEQ ID NO: 220 - DNA, 850 bp, Diabrotica virgifera
  misc_feature (1)..(850): WCRW transcript ta09615.001_diavv
gctattacaagtttcttttgtataagttttataaatattgttaatcgttaacatagtcctgtttacaaaatgtttcttacaagaagtgaatacgataggggagtcaataccttttcacccgaaggaagattatttcaagtagaatatgccatagaagctattaagttaggatctaccgctattggaatatgcaccagtggtggagtagtgcttgctgtagaaaaacgcattacttccccattaatggaacctactacgattgagaaaattgtagaagttgacaaacatattggatgtgcggtttcaggacttatggcagattcaaggactatgatagatagagctcgtgtggaatgtcagaatcattggtttgtctacaatgaaaatataagtgtagaatcctgtgcacaaggtgtatcaaatttggctattcagttcggagattctgatgaagatggtgcagccatgtctagaccttttggagtagcaattttgtttgctggtatagatgaaaaaggacctcagttgtaccatatggatccatcaggaacatttgttcagtttgacgcaaaggcgataggatcaggatccgagggtgcacagcaaagtttacaggaggcatatcatcgcagtatgaccctggaagaagctaccacaactgctttaacaattctaaaacaagttatggaagaaaagttgaattcttcaaatgttgaggttatgactatgactccaaaagatatgttccacatgttcacaaaggaacaagtggaagaggtaattgctaaattgtcttaacttaggaagtaagctaaattttgaaaagggttaattttatataagttttttt

SEQ ID NO: 221 - DNA, 404 bp, Diabrotica virgifera
  misc_feature (1)..(404): RNAi target sequence
  misc_feature (300)..(300): n can be any nucleotide
  misc_feature (301)..(301): n can be any nucleotide
  misc_feature (302)..(302): n can be any nucleotide
  misc_feature (338)..(338): n can be any nucleotide
  misc_feature (339)..(339): n can be any nucleotide
  misc_feature (340)..(340): n can be any nucleotide
  misc_feature (341)..(341): n can be any nucleotide
ttcggaagtaaaacaagtgctgcaggatgtggatactgaagatttgtacactaaatataaaaaacttcaacaacagttggagttcttggaggttcaagaagagtacattaaagatgagcaaaggaatctcaaaaaggagtatttacatgctcaggaagaagtgaagcgtatccagtctgtcccgcttgttattggacagtttttagaagctgtagatcaaaacactggcattgttggctcaactacaggttcaaattattatgttagaatcttatcaacaattgatagagaactcttaannnccttctgctagtgttgctcttcataaacacagcaannnncttagtagatgtcctaccaccagaggcagattcttcaataagcatgctccaggctgatgaaaa

SEQ ID NO: 222 - DNA, 22 bp, Artificial Sequence
  primer
  misc_feature (1)..(22): forward primer
ttcggaagtaaaacaagtgctg

SEQ ID NO: 223 - DNA, 20 bp, Artificial Sequence
  primer
  misc_feature (1)..(20): reverse primer
ttttcatcagcctggagcat

SEQ ID NO: 224 - DNA, 1364 bp, Diabrotica virgifera
  misc_feature (1)..(1364): WCRW transcript ta03370.001_diavv
aaaaaagtcaaaatttgaagaagaaaacaattttacaagtcatcaaccatggaggctatggatattgttataccagaaaaagaagaaggtagtccttcggaagtaaaacaagtgctgcaggatgtggatactgaagatttgtacactaaatataaaaaacttcaacaacagttggagttcttggaggttcaagaagagtacattaaagatgagcaaaggaatctcaaaaaggagtatttacatgctcaggaagaagtgaagcgtatccagtctgtcccgcttgttattggacagtttttagaagctgtagatcaaaacactggcattgttggctcaactacaggttcaaattattatgttagaatcttatcaacaattgatagagaactcttaaaaccttctgctagtgttgctcttcataaacacagcaatgccttagtagatgtcctaccaccagaggcagattcttcaataagcatgctccaggctgatgaaaaaccagatgttcaatacagtgacattggaggtatggatatgcagaaacaagaaattagggaagctgtagagttacctttgactcacttcgaattgtataaacagattggtattgatccccccagaggtgtgttgatgtatggacctcctggatgcgggaagactatgttggccaaagctgttgctcatcatactacagctgcctttattcgtgtagtcggatcagaattcgtacagaaatatcttggtgaaggtcctcgaatggttagagacgtgttccgtctagcaaaagaaaattctccagcaatcatctttattgatgaaattgatgcaatcgctaccaaacgttttgatgcccagacaggtgctgatcgtgaagtccagagaattttattggaactgcttaaccagatggatggttttgatcagacaacaaatgttaaggttatcatggcaactaacagagctgatacattagatcctgcacttctgagacctggtcgtctggacagaaaaatcgaatttcctttaccagatagaagacaaaagcgtttgattttcagcactatcacatctaaaatgaatttgtcagaggaggtcgacttggaggactatgtagctagaccagacagaatatcaggagcagacataaacgccatctgccaggaagccggtatgcatgccgtccgagaaaaccgttacatcgttttacctaaagatttcgagaagggttataagaataacattaagaaggatgagagcgagcacgagttttacaaatagtttatttatattttttattattactaatctaataaagacttgtaaaatgtatttgatgtcattgaatcaagtttacattaaaaaaa

SEQ ID NO: 225 - DNA, 455 bp, Diabrotica virgifera
  misc_feature (1)..(455): RNAi target sequence
cggaattaaatagtgcccaagatgaatatcacatctgcagcgggaattatttccctcttggatgaaccaagaccagaattaaaagtatttgcactgaagaaactagattccatagtgggtgagttttggccggagatctcagaagctatcgaaaaaatcgaaattttgcatgaagacaaagttttccagcaacaccagttagctgcacttgtggcaagtaaggtatattaccatttaggcgcttttgaagactctttaacttatgctcttggtgcgggtgatctctttgatgtcaatgcccggagtgagtatgtagaaactattctagctaaatgtatcgactattacactcagcaacgtattgctgtagctgaaggattggcagatgccaaacccatagactctcgccttgaagctattgttaatcgaatgtttcagaggtgtcttgatgatgg

SEQ ID NO: 226 - DNA, 22 bp, Artificial Sequence
  primer
  misc_feature (1)..(22): forward primer
cggaattaaatagtgcccaaga

SEQ ID NO: 227 - DNA, 22 bp, Artificial Sequence
  primer
  misc_feature (1)..(22): reverse primer
ccatcatcaagacacctctgaa

SEQ ID NO: 228 - DNA, 3242 bp, Diabrotica virgifera
  misc_feature (1)..(3242): WCRW transcript ta00483.001_diavv
tgaatatccacatcaaaaattgcattcattcaatgactgtgttgtttttccgacgtgaaagtttaaaaattacatttttcggaattaaatagtgcccaagatgaatatcacatctgcagcgggaattatttccctcttggatgaaccaagaccagaattaaaagtatttgcactgaagaaactagattccatagtgggtgagttttggccggagatctcagaagctatcgaaaaaatcgaaattttgcatgaagacaaagttttccagcaacaccagttagctgcacttgtggcaagtaaggtatattaccatttaggcgcttttgaagactctttaacttatgctcttggtgcgggtgatctctttgatgtcaatgcccggagtgagtatgtagaaactattctagctaaatgtatcgactattacactcagcaacgtattgctgtagctgaaggattggcagatgccaaacccatagactctcgccttgaagctattgttaatcgaatgtttcagaggtgtcttgatgatggtcaatatcgtcaagctatgggcctggctctagaaaccagacgaatggatatctttgagtcatctattactcagtctgatgatattatcagcatgttgacttatgcatttcaagtagcgatgagtttgattcaaaatcgagcatttagaaacactgttttgagatctcttgttggactttatagaggactggttacacctgattacgttaatatgtgccagtgcttaattttcctcgatgatccattgtctgtggctgaaattttagacaggcttgtaactggcaaggaggatactgaacttatggcatatcaaattgcttttgatctctatgagtcagctactcaacagtttttggaaagagtattagttgcattaagagccacagcaccagttccatctttgctggaagaaaaagcaaagccaaagccttctggtgaaggagagggtgctatgtcaaccgagactggagaaccatctacagaaacaaaagaagaaaaattaaaagaagaaaaatctctggatagtttgtctgatcaggataaggaacatcagaaaagaattgagaaacttcatactatactctcaggggaggtctctatagaactgcaccttcaattcctcatcaggtcaaatcatgctgatctactgattcttaaacaaacaaaagagactgtcagagttagtatttgccacactgctactgtaatcgcaaacgcatttatgcatagtggtactactagcgatcaatttttaagagataacttagaatggttagccagagcaacgaattgggccaaacttacagccacagcctcgctaggagttattcatagaggccatgaacaagaagcattaacactaatgcaaagttacttgccgaaagaagttggacccagctcaggttattccgaagggggcggcctttatgctcttggtcttatacatgccaaccatggtacaaatatcattgattaccttcttggacaacttaaggatgcacagaatgagatggtgagacatggaggttgtcttggtctaggtttggctgctatgggcactcatagacaggatgtttatgaacaactcaaattcaatttataccaagatgatgccaatactggtgaagcagctggtattgcaatgggaatggtaatgttgggttcaagtaattctaccacaattatggatatggttgcatacgcacaagagagtcaacatgagaaaattcttagaggcttagctgttggtattagtttttccatgtatggtagattagaagaagcagatccactgattcaacaacttacctctgataaagatcctatcctcagaagatcaggaatgtatactttgggtatggcatattgtggtactggacacaaccaagcaattagaaaactacttcatgtagctgtgtcagatgtcaacgatgatgttagaagagctgcagttacagctttaggttttctgttattcagaactcctgaacaatgtcctagtgtagtatcccttctagctgagagttacaatccacatgtacgttatggagctgctatggctcttggtattgcatgtgcaggaactggtctacgtgaagctatagctcttctcgaacctatggttatgtttgatcctgtaaacttcgtaagacagggtgctctcattgcttctgctatgattttaattcaacagactgaacaaacttgccccaaagtcacattcttcagacagacatatgctcaagtcatttccaacaaacacgaagatgtgatggccaagtttggagctatcttagctcaaggaatcatcgatgcaggtggaagaaatgtaactttgtcgctacagtccagaactggccacacaaatatgttagctgtagttggtacactggtgttcactcagtactggtactggttccctctatcacattgtttagctttagcattcactccaacatgtgtgattggtcttaatgcacaattgaagatgcccaaattagacttcaaatccaatgccaaacctagtctatatgcttatccagctccaatggaagaaaagaaaagagaagaaagagaaaaggtaactactgccgttttaagtattgctgcccgccaacgtagaagagaccatgaaagaaagcatcgtgacgaaaagatggaagtagatgaagacaaagatgacaagaaaacagaaaaagaagacaaggagaagaagtctgaagagaaagataaaaaggatgaaaagaaagctgatgacaaagataaagataaaaaagcagatgacaagaaagcatctacttctactggcgatgataagaagaaggatgaaaaggaagaaaagaagaaagaacctgaaccaaacttcgaagttttacagaatcctgctagagttatgaggcaacaattaaaggtgattacacttaatgatagcaatcaacatgtttcgatgaaagatgtttctattggaggaataatcatggtgagaaatttgaagcctggagatgaggaactggttgaacctgttgcagcttttggtcccaagggcgaggatgaaaaggaaccagaacctccagagccgtttgaatggacagaagattagatatcatcattaacatttttataatttttcatttaatttactataaatagatgtaattatacgaaaaacgacttttgttaacatttaatattaaattattagtttagcg

SEQ ID NO: 229 - DNA, 701 bp, Diabrotica virgifera
  misc_feature (1)..(701): RNAi target sequence
agctcgcttttatatgagatccgcaacgttcataggcatttcatctatctttgtattatagaactgttcgatatccttaagcgtgcgtttatcatcgtccgttacgaaatttattgctacacccttacgaccaaatcgaccacctcgaccaatcctgtgaatgtaattttctctattagaaggcaaatcataattaataactagggaaacttgctgtacatctatacctctcgctaacagatcagtggttattaaaaccctagatgatcctgttctgaactgacgcataataacgtcacgctctctttgttccatatcaccatgcatagcggaaacagtgaagtctctcttgtgcatgttttctgttaaccaatcgaccttgcgacgggtattgcaaaagattacagcctgcgtaatcgaaagagtatcatagagatcacataatgtctctaatttccaatcttctttttctacatatacataaaattgtttaataccttctaaggtaagttcctcttttttgacaagtatccgaacaggactcctcataaaggattttgtcacgtctagcacatcgtttggcatggtagccgaaagtaaaattacctgtacgtcagtgttcaacattttgaacacgtcatgaatttgatctttaaaaccccttgacaacatttcatcggcttcatccaaaacaaacattt

SEQ ID NO: 230 - DNA, 27 bp, Artificial Sequence
  primer
  misc_feature (1)..(27): forward primer
agctcgcttttatatgagatccgcaac

SEQ ID NO: 231 - DNA, 28 bp, Artificial Sequence
  primer
  misc_feature (1)..(28): reverse primer
aaatgtttgttttggatgaagccgatga

SEQ ID NO: 232 - DNA, 2338 bp, Diabrotica virgifera
  misc_feature (1)..(2338): WCRW transcript ta03651.003_diavv
aaacgaccacagacagactcactttcaggtaaaaaaatcctaacttatttgttaccacaagttagaagtggttaaaagcatcctagaagccactaagtgaattgcaatacctgggcggagcgacagtattcctatcacttcaaacttcaattcagggggcttttccgtttagctatacgcgaagtagacatgtctatgccagatcgtcgtgaagagtgggacaagaatggcccagctaatgaagacagccagccccaaggctatgacggcccaccaggtatggagcctgatggcattattgaatccaactgggaagaggtggtcgataatttcgacgacatgaacctaaaagaggaacttttaagaggaatttatgcctatggttttgaaaaaccttctgctatccaacagagagccatcattccttgtgtaaagggacacgatgttattgctcaggctcagtcaggtactggtaagactgcaacattctccatctctattttacaacaaattgacacgtcagtgagggagtgccaagctcttatattggcaccaactcgtgaattggctcaacagatccaaaaagtagtaattgccctaggagatttcatgtcagcgcagtgtcatgcatgtattggtggtaccaatgtacgagaagacataagaaaacttgaaactggcgtacatgttgttgttggtacacctggtagagtttacgatatgataacgaggagagccctaaggccgactcatattaaaatgtttgttttggatgaggctgatgaaatgttgtcaaggggttttaaagatcaaattcatgacgtgttcaaaatgttgaacactgacgtacaggtaattttactttcggctaccatgccaaacgatgtgctagacgtgacaaaatcctttatgaggagtcctgttcggatacttgtcaaaaaagaggaacttaccttagaaggtattaaacaattttatgtatatgtagaaaaagaagattggaaattagagacattatgtgatctctatgatactctttcgattacgcaggctgtaatcttttgcaatacccgtcgcaaggtcgattggttgacagaaaacatgcacaagagagacttcactgtttccgctatgcatggtgatatggaacaaagagagcgtgacgttattatgcgtcagttcagaacaggatcatctagggttttaataaccactgatctgttagcgagaggtatagatgtacaacaagtttccctagttattaattatgatttgccttctaatagagaaaattacattcacaggattggtcgaggtggtcgatttggtcgtaagggtgtagcaataaatttcgtaacggacgatgataaacgcacgcttaaggatatcgaacagttctataatacaaagatagatgaaatgcctatgaacgttgcggatctcatataaaagcgagctaataaagagtgttggtgtgttctacgacgtctcctgaagtatctttggtgtgagtattagctttctatgctaaatctgctgcgacatatatatgcgaatattgtgcgctgcgccccatcacgtttctttaggacaacgccgttcgaggcacaatcatccacgaactctctgagtgtcaatttttaaatatatttaattgtttcggtttaatctctagtgtatttttaattttttgatatacatatagttagtgtttattatcattcgggagacgtgtggctgtatggaggcccgaggtcccctcgtttcgaggggtaccgacggtcgtaggcgtgttgtgatttgctccacacagttcgttcgtctctgtaagggtttagttggtatctggaaaggttattataatcgtaaaagatgtagaaggaaattctggattatcacatagactttttgtacattaagacttaataaaagtggtgataaaattcgttgccttttctttatgttttattataactggtgtgtctaaagatttgttgaattgtgaatctgcatatatactgtttagagagagactcacaggtgagtaatcgtactgtttgaacagaaactttatagtacattcttagtttcattctgtgttatatttgtttaataatcacagttaaagttaacacaaaatgcaaaaaacactaacataaacttttgatgttgatagtttgttgaaattatcttccgtgtttgttatagttttttttggctctagcttttgtaaaagtaataatcattagcgaactagtaggcctatggcttgattgaccattcttcatcctttcttgttcattgctttcatcctccaatttgtgatgttgagtttttt

SEQ ID NO: 233 - DNA, 669 bp, Diabrotica virgifera
  misc_feature (1)..(669): RNAi target sequence
gtgaagagtgggacaagaatggcccagctaatgaagacagccagccccaaggctatgacggcccaccaggtatggagcctgatggcattattgaatccaactgggaagaggtggtcgataatttcgacgacatgaacctaaaagaggaacttttaagaggaatttatgcctatggttttgaaaaaccttctgctatccaacagagagccatcattccttgtgtaaagggacacgatgttattgctcaggctcagtcaggtactggtaagactgcaacattctccatctctattttacaacaaattgacacgtcagtgagggagtgccaagctcttatattggcaccaactcgtgaattggctcaacagatccaaaaagtagtaattgccctaggagatttcatgtcagcgcagtgtcatgcatgtattggtggtaccaatgtacgagaagacataagaaaacttgaaactggcgtacatgttgttgttggtacacctggtagagtttacgatatgataacgaggagagccctaaggccgactcatattaaaatgtttgttttggatgaggctgatgaaatgttgtcaaggggttttaaagatcaaattcatgacgtgtttaaaatgttgaacactgacgtacaggtaattttactttcggctaccatgc

SEQ ID NO: 234 - DNA, 22 bp, Artificial Sequence
  primer
  misc_feature (1)..(22): forward primer
gtgaagagtgggacaagaatgg

SEQ ID NO: 235 - DNA, 22 bp, Artificial Sequence
  primer
  misc_feature (1)..(22): reverse primer
gcatggtagccgaaagtaaaat

SEQ ID NO: 236 - DNA, 1764 bp, Diabrotica virgifera
  misc_feature (1)..(1764): WCRW transcript 454run12_isotig05267
ttttcaccacttttattaagtcttaatgtacaaaaagtctatgtgataatccagaatttccttctacatcttttacgattataataacctttccagataccaactaaacccttacagagacgaacgaactgtgtggagcaaatcacaacacgcctacgaccgtcggtacccctcgaaacgaggggacctcgggcctccatacagccacacgtctcccgaatgataataaacactaactatatgtatatcaaaaaattaaaaatacactagagattaaaccgaaacaattaaatatatttaaaaattgacactcagagagttcgtggatgattgtgcctcgaacggcgttgtcctaaagaaacgtgatggggcgcagcgcacaatattcgcatatatatgtcgcagcagatttagcatagaaagctaatactcacaccaaagatacttcaggagacgtcgtagaacacaccaacactctttattagctcgcttttatatgagatccgcaacgttcataggcatttcatctatctttgtattatagaactgttcgatatccttaagcgtgcgtttatcatcgtccgttacgaaatttattgctacacccttacgaccaaatcgaccacctcgaccaatcctgtgaatgtaattttctctattagaaggcaaatcataattaataactagggaaacttgctgtacatctatacctctcgctaacagatcagtggttattaaaaccctagatgatcctgttctgaactgacgcataataacgtcacgctctctttgttccatatcaccatgcatagcggaaacagtgaagtctctcttgtgcatgttttctgttaaccaatcgaccttgcgacgggtattgcaaaagattacagcctgcgtaatcgaaagagtatcatagagatcacataatgtctctaatttccaatcttctttttctacatatacataaaattgtttaataccttctaaggtaagttcctcttttttgacaagtatccgaacaggactcctcataaaggattttgtcacgtctagcacatcgtttggcatggtagccgaaagtaaaattacctgtacgtcagtgttcaacattttaaacacgtcatgaatttgatctttaaaaccccttgacaacatttcatcagcctcatccaaaacaaacattttaatatgagtcggccttagggctctcctcgttatcatatcgtaaactctaccaggtgtaccaacaacaacatgtacgccagtttcaagttttcttatgtcttctcgtacattggtaccaccaatacatgcatgacactgcgctgacatgaaatctcctagggcaattactactttttggatctgttgagccaattcacgagttggtgccaatataagagcttggcactccctcactgacgtgtcaatttgttgtaaaatagagatggagaatgttgcagtcttaccagtacctgactgagcctgagcaataacatcgtgtccctttacacaaggaatgatggctctctgttggatagcagaaggtttttcaaaaccataggcataaattcctcttaaaagttcctcttttaggttcatgtcgtcgaaattatcgaccacctcttcccagttggattcaataatgccatcaggctccatacctggtgggccgtcatagccttggggctggctgtcttcattagctgggccattcttgtcccactcttcacgacgatctggcatagacatgtctactccgcg

SEQ ID NO: 237 - DNA, 628 bp, Diabrotica virgifera
  misc_feature (1)..(628): RNAi target sequence
tcattgtgtcctaaaggcatgatcataacgataagtcagcagatgcaaacatccaacttagaacatgccaatttctcttttttctagttttgtaattttttcttcatttatatctgggattaaaaactttattcctttaaatgtaacgttaatatatgaatctcataactagtgttaccccttagatttaaccaagagagaaaataacgctctggtctacatataagtaaacattgcctaatttaaattgatgtttcagaacattcgtcgcagaactcagtttctatgttaaacaacttggaagaactattcatggaagggatactggatctaataaacagactgcaagtaaaagttgtgccctatcagttgtgcgacaactttttcacttgaaagtcattgaagctttttcaggtatgtagaaatgtatatctttctttttaattcctttctctttttatacagagaggggctaaattgtggagtgaattgattttatctagaatggaccactttggagagaaatcgcgaaacgggtcgatttttatttttgaattacaatttttttgcatatgtttcatactggtgacgtcatccatctgggcgtgatgacgtagtcggtgatttt

SEQ ID NO: 238 - DNA, 22 bp, Artificial Sequence
  primer
  misc_feature (1)..(22): forward primer
tcattgtgtcctaaaggcatga

SEQ ID NO: 239 - DNA, 22 bp, Artificial Sequence
  primer
  misc_feature (1)..(22): reverse primer
aaaatcaccgactacgtcatca

SEQ ID NO: 240 - DNA, 697 bp, Diabrotica virgifera
  misc_feature (1)..(697): WCRW transcript ta41281.001_diavv
ttaaaaaaatcaccgactacgtcatcacgcccagatggatgacgtcaccagtatgaaacatatgcaaaaaaattgtaattcaaaaataaaaatcgacccgtttcgcgatttctctccaaagtggtccattctagataaaatcaattcactccacaatttagcccctctctgtataaaaagagaaaggaattaaaaagaaagatatacatttctacatacctgaaaaagcttcaatgactttcaagtgaaaaagttgtcgcacaactgatagggcacaacttttacttgcagtctgtttattagatccagtatcccttccatgaatagttcttccaagttgtttaacatagaaactgagttctgcgacgaatgttctgaaacatcaatttaaattaggcaatgtttacttatatgtagaccagagcgttattttctctcttggttaaatctaaggggtaacactagttatgagattcatatattaacgttacatttaaaggaataaagtttttaatcccagatataaatgaagaaaaaattacaaaactagaaaaaagagaaattggcatgttctaagttggatgtttgcatctgctgacttatcgttatgatcatgcctttaggacacaatgaagaaatgtaactcacagtttacttcttttatttaggtttttggataaggatttttttgaatccc

SEQ ID NO: 241 - DNA, 610 bp, Diabrotica virgifera
  misc_feature (1)..(610): RNAi target sequence
  misc_feature (560)..(560): n can be any nucleotide
ccttcaccaatttccccttactcgggggtaaatacaacagcggacagtacacttacaaaatctaccatttggccagcaaagtaccggcgttcataaggctcctggcaccgaaggggagtttggagatacacgaagaggcttggaatgcttacccatattgtaggaccgtcattacgaatcctggttatacgaaggagaattttgttatttgtattgaaagtatgcatattgctgataatggtcatcaggttaacgttcatgacttacccagtgacaaattgaaacaaagagaagtggtacacatcgacatcgctaatgatagtgtatcgtcgggagattacaaagatgacgaagatcctacgaagtttaagtctcaaaagacgggcaggggaccgctcgtgggtcctgattggaaggacaaagtcaatcctgtgatgacgtgttataaattagtaactgtagaattcaaatggtttggtttacagacgaggatagaaagttttatacaaaaatctgaaaggcggctatttacaaatttccatagacaagttttctgttgnatggaccgctggcacggtctgacgatggaagacatccgtgcaatagaaga

SEQ ID NO: 242 - DNA, 22 bp, Artificial Sequence
  primer
  misc_feature (1)..(22): forward primer
ccttcaccaatttccccttact

SEQ ID NO: 243 - DNA, 23 bp, Artificial Sequence
  primer
  misc_feature (1)..(23): reverse primer
tcttctattgcacggatgtcttc

SEQ ID NO: 244 - DNA, 800 bp, Diabrotica virgifera
  misc_feature (1)..(800): WCRW transcript ta20868..001_diavv
  misc_feature (715)..(715): n can be any nucleotide
aattgcagcaaagaaaacatgctgattaaagaataccgtgtgaccctacccctcacagtcgaagagtaccaagtggctcaactattcagcgtggcagaggcttccaaagacaacactggcggcggagaggggatagaagtattgaaaaatgaacccttcaccaatttccccttactcgggggtaaatacaacagcggacagtacacttacaaaatctaccatttggccagcaaagtaccggcgttcataaggctcctggcaccgaaggggagtttggagatacacgaagaggcttggaatgcttacccatattgtaggaccgtcattacgaatcctggttatacgaaggagaattttgttatttgtattgaaagtatgcatattgctgataatggtcatcaggataacgttcatgacttacccagtgacaaattgaaacaaagagaagtggtacacatcgacatcgctaatgatagtgtatcgtcgggagattacaaagatgacgaagatcctacgaagtttaagtctcaaaagacgggcagaggaccgctcgtgggtcctgattggaaaggacaaagtcaatcctgtgatgacgtgttataaattagtaactgtagaattcaaatggtttggtttacagacgaggatagaaagttttatacaaaaatctgaaaggcggctatttacaaatttccatagacaagttttctgttgnatggaccgctggcacggtctgacgatggaagacatccgtgcaatagaagataaaacaaaagaagaactagaagctctccgtcaaa

SEQ ID NO: 245 - DNA, 524 bp, Diabrotica virgifera
  misc_feature (1)..(524): RNAi target sequence
ggttgccgtcgtttagtagaagtgtcatttttgtctgctctcgttttcatcttttgtgtataaaattggtgctaaggtagataaactatattcgaataggcgtttttatgtcgcaagaaagtgttttgtatatttgtgatacgtgatctcgtagagggagtccagaaattcataatttatagttaagtaaaaatggcggcaaacagaactggacctgctcagagaccaaatggcgctacccaaggaaagatatgtcagttcaaactggtcctactaggcgaaagtgccgtcggtaagtcgagtttggtactgaggttcgtcaaaggacagttccacgaataccaggagagtaccataggagcagctttccttacacaaaccatatgcctcgacgatacaactgttaaatttgaaatttgggacacagcgggtcaagaaaggtaccacagtttagctcctatgtactataggggcgcacaggcagctatagtcgtctacgacataaccaatcaagacacattcgg

SEQ ID NO: 246 - DNA, 22 bp, Artificial Sequence
  primer
  misc_feature (1)..(22): forward primer
ggttgccgtcgtttagtagaag

SEQ ID NO: 247 - DNA, 22 bp, Artificial Sequence
  primer
  misc_feature (1)..(22): reverse primer
ccgaatgtgtcttgattggtta

SEQ ID NO: 248 - DNA, 3182 bp, Diabrotica virgifera
  misc_feature (1)..(3182): WCRW transcript ta01834.005_diavv
ctcaaatattggcagccttgttgacgtcgtttagtagaagtgtcatttttgtctgctctcgttttcatcttttgtgtataaaattggtgctaaggtagataaactatattcgaataggcgtttttatgtcgcaagaaagtgttttgtatatttgtgatacgtgatctcgtagagggagtccagaaattcataatttatagttaagtaaaaaatggcggcaaacagaactggacctgctcagagaccaaatggcgctacccaaggaaagatatgtcagttcaaactggtcctactaggcgaaagtgccgtcggtaagtcgagtttggtactgaggttcgtcaaaggacagttccacgaataccaggagagtaccataggagcagctttccttacacaaaccatatgcctcgacgatacaactgttaaatttgaaatttgggacacagcgggtcaagaaaggtaccacagtttagctcctatgtactataggggcgcacaggcagctatagtcgtctacgacataaccaatcaagacacattcggcagggcgaaaacgtgggtgaaggaacttcaaaggcaggccagtccgacgatcgtgatagctttggccggcaacaagcaagatttggccaacaaacgtatggtagaatacgaagaggcgcagacgtatgctgacgaaaacggcttactttttatggaaacttccgcaaagacggcaatgaacgtcaacgatatatttttagcaatagctaagaaactgcccaagaatgaacaaaccacaggtcaaggcggcagtgcccaaggcaggcggctagcggagggcgattcgggcgccaaggcacccggaaattgttgcaagtgatggtatacgcctgcaggtcgagtgttgttattaaaccgtcacgagaaaggactggcaagtgcagcggcactctagtgatatctatgtgtaataaaggtccttctattaacaaaaaaaaattaataaaaaaatatattaaacttcatatacactgtcacatattccatttagatgatgaaaaacaaaagagcagaagcattttggtctctaacggtcatgttgagttggaatgtctcgtggggcatttaaatttgtgataattgtacctatattttgtttttttatatatataattaatatatctgacagtgtaagttaagcgtaaactgtttatatcgatcgtattagcagcaccaattaaaaaaataaataaaattgaagatcttttttattgtttttgtaattttaactctttggggaaggttacaaaagaattgataacgttgtgttgaaaacattgcattataataaagtaattccacccacttacgaattattttgaaaggagaatcaaaaatgtgtcaattgtcacctgtcatcttatgatgacactctatgagagtgggggcaattgcagcgcgcgcatactattcagtctagcttcattatgtcaattaaatatcgatgtgcattagaaatactgcctaattgaatattttcgacatatgattaaaatttcatcgattagtttgacagttcccaaatgaaaaaacagttacttccgcataaaaatgtattgcttcaaaacttactttcagtggcatttcagtgggttttagccatcttatggagagtggtctaacacactttctaggtacagctgtggtttttaaaaggaaatataatgaatcgcttttgttttcgaaatttacattgggaatcccttagtgtccttatatttgccctacagagtttcatttaaactgaaattgggtaatttacatagacctaaagctttcacgtctatatagcctaattagaccacaaaattgacttgctttacgtgaaatgtatgaaccattcaaacatatttatatgacaacaatataatataatacaatataatataaataactgacaacatttaaaattagaatttttacccacaatttttctctgccatgtgtcatctaatacaagaagtatggcaatttagccctactcctcttattgtacatttcttgtaattcctcattttctttttcaattacttcgatcttttaaacttaattcaccaagtttatttgcaatattgttcttgaagtctatagtttgaattccttcaatatatttgtaatgtttttcttcagtgtcaatccttgcattccatgaaagaacacgaaaaagatgcagcactttatttgtccatattcctgctacatagttatttttcgattaacacattcactgccagcgtatagtaaactggcactttactatacgctaaacaaaaatttggccttgcagattttcctaaaacacgtagcagctacgccactgaatggacttaggaccccctatcgtttcgctggttgcaatagtccggtaactagagacaaaagtgggtcattttgcacacttcatataattctcgttttctgtacttcacgagtattttttttgtcggatatgtattgaatagtatcggtgacaacacactgccctgcgtgacacccctttcaaaacctatgtgggaacaatatgtatctttagagaactttttgtacccttcccctaaaaactaaatattttttcacttagtgcaattttaatattagtctcaccttatttctagaatacggtcgatctaaatgtataatctcaactttcagcttatacttcgaaaaccgagaagtataaactgtaagaatatttaacgttatatgtattttattaggataatgattgttgaaagtatgtttcccaacacgtgtaagttacatttcgtactctttccatttttattacaaaaaaaaatgtttatttagataaactgttgcggaacatactttctcgatgcatgactgaaaagaacgttaacatttatacgtatttgtttttattttgtgtctgatgtgacaacccagatcttagcgaaagcgtagaggacaaaagatgagtttttaagtttcccattgaactttttccgtccttaaatcaaatacaacaactattcacttaagttttctaaacatttttgctaatatgggcccctgcaccattcccgacttaacagtcttcatttgtttttattaggtttgttcgtagtacgatccaaacgatcggcaaccgttgccaaccattagacgcatgcgcgttc

SEQ ID NO: 249 - DNA, 529 bp, Diabrotica virgifera
  misc_feature (1)..(529): RNAi target sequence
atttttgaggttgtcggctagaagttcgcaaagtaaatctaaattccaacaattaaaccgaaatagttctttaaaaaagatgtttcgaaaccaatacgatagtgatgtgacagtgtggagcccccagggccgtctgcatcaggtagaatatgccatggaagcagttaacctaggttcagccacagtgggactgaaaagtaaaactcatgctgtacttatcgctttgaagagggcttcttcagaactgtctgcctaccagaagaaaattatcaacatagacgatcacattggtatcaccatctcgggacttacagctgatgctaggatccttagtagatatatgcgaaacgaatgcttgaattataagtactctttggatacttatatgccattgaataggcttatcagtattttaggtaacaaaatgcagacatgtacccaaagatacgaccgcagaccatttggtgtaggtcttctagtagctggttatgacgaatctggttctcatatctaccaaacgtgcccttct

SEQ ID NO: 250 - DNA, 22 bp, Artificial Sequence
  primer
  misc_feature (1)..(22): forward primer
atttttgaggttgtcggctaga

SEQ ID NO: 251 - DNA, 22 bp, Artificial Sequence
  primer
  misc_feature (1)..(22): reverse primer
agaagggcacgtttggtagata

SEQ ID NO: 252 - DNA, 1051 bp, Diabrotica virgifera
  misc_feature (1)..(1051): WCRW transcript 454run3_isotig10716
cgatgttctgccgtgactgtctcggtctgctttagactaacagagacagccacggcaatattcctttccaataccccctctcctgatcaacgggtggctttaatgctttatctaatccttctattctgtggtatccatggcagaagtttccacagctgggactgcatccctgggctcgtcccccgcatcatctctcaacggatctgcaggaaggtcctcaattgcagcagctgcagctcctcctcctctacgttcttcaccctcaataagggacaagtagggggaagtttcttcttcttcgaggattttaaaggtctgacctttgccagtgtatcctatggagacattttttgttgtgaggtcaacctctggaggtagagtatctctaagagccctcaatccatgtttgataagttcttctaaagaactagatggcaattcatccagatgtttttctaagtatgtcctggcactctgggatcgagctccaatggacatagctttgcaatcgtagaaattagcagaagggcacgtttggtagatatgagaaccagattcgtcataaccagctactagaagacctacaccaaatggtctgcggtcgtatctttgggtacatgtctgcattttgttacctaaaatactgataagcctattcaatggcatataagtatccaaagagtacttataattcaagcattcgtttcgcatatatctactaaggatcctagcatcagctgtaagtcccgagatggtgataccaatgtgatcgtctatgttgataattttcttctggtaggcagacagttctgaagaagccctcttcaaagcgataagtacagcatgagttttacttttcagtcccactgtggctgaacctaggttaactgcttccatggcatattctacctgatgcagacggccctgggggctccacactgtcacatcactatcgtattggtttcgaaacatcttttttaaagaactatttcggtttaattgttggaatttagatttactttgcgaacttctagccgacaacctcaaaaat

SEQ ID NO: 253 - DNA, 533 bp, Diabrotica virgifera
  misc_feature (1)..(533): RNAi target sequence
aggcataacggtcaaagaggtagaggttattataataataatcgggattccaggtatggcgatagagactatcgaggcagaggcagaccgtacgggttccaaaatagaggtaatcgaagacaacagcgcggtagatatggttctagaggagggggaggatacagagattatagggatcgcagatattcaagaagcagatcccgcgaccgcgatcacagcaggtcatacagtcagagcaactcagacgcctctcctccatcgaaacgagacaggtcttctcctccatccgagaaagaaaagatcaacaagtattctgacggagacgcgcccatccagcatgaaggaccgctttctgagggcgaggacagggacgattacatcagcaccgataccagcaagttgatcgatagggaaatcggtggtaaatgggctgataaagaagctgacactagtaaggaggaagccaaagagagtgggcaagggaatactgtggaagtaaaggagtaaagaggtggactttcttttaagtcgtt

SEQ ID NO: 254 - DNA, 22 bp, Artificial Sequence
  primer
  misc_feature (1)..(22): forward primer
aggcataacggtcaaagaggta

SEQ ID NO: 255 - DNA, 24 bp, Artificial Sequence
  primer
  misc_feature (1)..(24): reverse primer
aacgacttaaaagaaagtccacct

SEQ ID NO: 256 - DNA, 3832 bp, Diabrotica virgifera
  misc_feature (1)..(3832): WCRW transcript ta01498.002_diavv
ggggaagataaaataatttcctggtaaatagcttgtcagtgattattaatttatcgtttttattaaaagtatctattttaatctagaatttctcattattaatacaatattttctaaataattgtcacttaaattacaatttttacagaaataaagtattgccgttgaaaaatatctacaaaaccactttggggggtgttcaaaatggacgtcattcttcatattcgctaattgccggtgaaaaatattgtctagagttaaaatggaaacagtaaattcacagttgttgaccaaagccataaactttcatggtcaacagctgcagaagttgtgggaaggagaatttggagaaaatgatttgacaagaaaaaatgtcaaagatttgaattacaatgtgtatagtcaacgccagaagaacctatcttttcaagatagaggtaaacggttgaaactccaacagtttttgataaagaaggctaattttatctatagtttggaacccacgaagcaaaagaacaatgagaaagcgattactgaagatatgtatgctgttatgcctccttttgaaacttacaccagtgtagacaaacaaaaaagagtggcattcttcatggagaatgtgaaagtaggtaatctaatcctgggcaccattgtgagcagacaacaatcaggaatgatgttgaaagtgttgtgtactactggaaatggtaacacttgtttatatgctgctgatatcaacgtcaaggcattctgtccagttgcaaatgtcattaatgcagtggacaaaaagggggtatcacgcaactacatgatgaatgactatgtgtgttgtgaagtgctggaaatcatgcctgatacagataagctaatatgtggtatgatgggtgtgactaggaaatcatcagatccagaacatcgaccacctctagggcttattagtactgaagattttcctcttatatacaaaaaagcgttggatcacaagagtgagagttacgacagtgttttagagaagagcaccgggttcaataaccccaataacattcaatacctctcagaacagatggatgttggtaaacatctcagcttcatcacaggcttaaagtacaggttcccggaaaacgaatatgccaccgagttgagacaagtccaggccagtaaatgggcttaccgcaatgtagcagacggcatagatcattttaaggcgggaaaacacgtggaagcgttccaatgtctcaacaaagccctcaatatagatcccaagaatgtcgaaggtctcgtagcgagaggtgcgctctatgctaacagtggaaatttccagaaggccatcgaagatttcgaaactgctttgaagctgaatcctaatcatggaaacgctcgaaaatatatgggagaaactctcgtcgcattaggaaggagctacgaggaagaaaataaattagaggaagctagaaaagcgtaccagagctgcttgactatcattccttaccacgaagaagctcagaactctttggatttcttaaaatccaaagttcaaccaaaaaatcttattgaacccactgaacttctactgccaagtttgaacgttccctctaagcaaactgacatgaatgacgcgcttaaacaacttctaaagaccgaggaagaagacaaaaaagataagaagaagaaaaagaagagcaagaagcgcaagagtcgaaaacgctccagttctagctcaagttcgagctcgtcggcaagtggagaatcctcctcgagctcgtctagcagctccagcgactcaagctctagctcgggcgattccgattttaaaaagcgcaagaagcacaggtcgaggtctcaccggcgtaaagaacgcgagaattcgctcagtcctttgagcaagaggatggctttgatggatcagagccatgacactcccaataccagttacaatttcaacaaaccagcaagttccagctttgagtttagctttgaacatccagagccttctaaaccacctgagaacgaatacgaaaataaattgagggccttcctggatcaaaccaagggcgactccgactatgaggacaaactgagaaaattcctggaagagacaaaatggaagaaaggcaaaggcgaggacaaaaagaagaagaaaaagaaagagaagaaggccaagaaagagagcaagaaaaagaagaagaaggaaaagatcaagagaaaacagagcttcgatttgagcgaattggacgaccacaagaagctaagggacgccattaagaaggaattgagcaaagaaaagaaatcgaagaggcacagtttggcgtctgaagacgacgagtacatcctgcagaagtcgggttatagtaagaacattaaagaacgaagcgcgagccctcccaagcgcattatagactccccgtctcccacaagggagcagaaggcgcgacaggcagtagccgaagctacggcctctgcgggggcccagaagtggaaaatgcaaattgccggcagttcgggcaattccaggttcaaaaagaagcccgaaagagcgcctcctgcttctgattggcagtctgatagagacaaacgagagcgggagcgagaacgcgatagagagagggaaagagagagagaacgtgctaagagctcttctgcctctgacgattctccaccaccgaaaaaaatgtctttgcctccacttcctccagctgagaaggccgttagtgtgcgcaaggccatggcattgaaagaaccgccactcaaaaagcctgagtctcccaaaaagttaaaactgactccagctccacccttgccgaaaataccgcagggacaagttgtgcttgataaatttggaaacttcaggctgatttctccgcctgaattgaaaaagggagaaggaacgagttcaggtcgccgcccaccggagcccccaggtcgcccgcgcagcgacagccgctcgccgaaacgccgcagtcgcagccgttccagatcgtcgagcggatcgcgatctcgctcgcggtctcgctctcgaagctaccgctcgcgatcgcgcagctactacagcaggtcgcgatcgcgcagcggctcctactactcacgcagtcgcagccgctcgcgcagttactccggagaccggcgcaggtacaaccgcagaggcggcttcagaggcaggcatctcaacgacaggggcacgtactacaaaccgaggttccaaacgccaaggcataacggtcaaagaggtagaggttattataataataatcgggattccaggtatggcgatagagactatcgaggcagaggcagaccgtacgggttccaaaatagaggtaatcgaagacaacagcgcggtagatatggttctagaggagggggaggatacagagattatagggatcgcagatattcaagaagcagatcccgcgaccgcgatcacagcaggtcatacagtcagagcaactcagacgcctctcctccatcgaaacgagacaggtcttctcctccatccgagaaagaaaagatcaacaagtattctgacggagacgcgcccatccagcatgaaggaccgctttctgagggcgaggacagggacgattacatcagcaccgataccagcaagttgatcgatagggaaatcggtggtaaatgggctgataaagaagctgacactagtaaggaggaagccaaagagagtgggcaagggaatactgtggaagtaaaggagtaaagaggtggactttcttttaagtcgttaaagaagatttgttttaagtgtttgctatgtaatataattttttcataatatagaaataaaggttaattgtacacgaaaaaaaaaaaaaaaaaa

SEQ ID NO: 257 - DNA, 583 bp, Diabrotica virgifera
  misc_feature (1)..(583): RNAi target sequence
tgggccagttaagttcgtattccacaacaaaagaatggacccgtggaagaaaagcacttttgggaagcttagggcttattgctggtggtactggtgccttgctgtttgctttggaccaatcagttaaagcatctgatcttgaattgcatcctccaaagaatgtttggagtcattctggaactttcaattccttggatcatgctagtgtaagaagaggttatgaagtatacaaacaagtatgtgctgcctgccactcaatgcgcttcattgcttaccgtaacttaattggagtttcccacactgaagcagaagccaaagctgaagctgaagaacaaatgattgaagatggtcccgatgacacgggtaactttttcaaaagaccaggaaagttatctgactacttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaaccc

SEQ ID NO: 258 - DNA, 22 bp, Artificial Sequence
  primer
  misc_feature (1)..(22): forward primer
tgggccagttaagttcgtattc

SEQ ID NO: 259 - DNA, 22 bp, Artificial Sequence
  primer
  misc_feature (1)..(22): reverse primer
gggttgaagtattgtccgtctc

SEQ ID NO: 260 - DNA, 1332 bp, Diabrotica virgifera
  misc_feature (1)..(1332): WCRW transcript ta01835.001_diavv
ggggggtacgtgctaggtgcagactggtattacgtaaagtgtcaaaaaattgtatattttttcttagtagcttcctaaaagtgcttaaattctatcaaactagctttctatcacctaaatacttcatgttactctaatctaagggtacgaggggtacaaaataaatttcacataacctatctgcatagtttttgaggggaccctttaggcaacatggctgcaacaataggacgaatttgtggagctggtcttttaaaaccaacaaacttatcctctgtgggccagttaagttcgtattccacaacaaaagaatggacccgtggaagaaaagcacttttgggaagcttagggcttattgctggtggtactggtgccttgctgtttgctttggaccaatcagttaaagcatctgatcttgaattgcatcctccaaagaatgtttggagtcattctggaactttcaattccttggatcatgctagtgtaagaagaggttatgaagtatacaaacaagtgtgtgctgcctgccactcaatgcgcttcattgcttaccgtaacttaattggagtttcccacactgaagcagaagccaaagctgaagctgaagaacaaatgattgaagatggtcccgatgacacgggtaactttttcaaaagaccaggaaagttatctgactacttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaacccctatttccccggtggtgccatttcgatggcacaagccctatataatgaaaccatagaatacagtgacggaacaccagcaactgccagtcaactcgccaaagacgtcgctgtgttcctaaaatggacgtcagagccagagcatgatgacagaaagaaaatgttaatcaaagtgatcggcatcttttctcttcttattggtatcacttactatgctaagaaactcaaattctcttcactgaaatcgagaaagattgaatttaggcccaagagtaaataaataagtattgtagatgaattttaaacaaggtttagcgtgactaccatagttattattatcttaaggtctaattttattgtacatatttacagactttccaactgactggggtttgcatttgccaccttggtttatttattttttccaggctttattattattgtgtcacgttatgtttcaataaaaaaaaataat

SEQ ID NO: 261 - DNA, 546 bp, Diabrotica virgifera
  misc_feature (1)..(546): RNAi target sequence
gatcccctgcacttggattatgttattgctgcagctaatttgaaggctgaagtttatggtataccaactagtagaaatagagaacaaatcgcagaagtggttatgcaagtcaatgttccagaattcatccctaaatctggcgtaaagatagcagttacggattctcaaatggctatgaatggtaataatgtggatttggatcgtgtttcccaaattaaagaagaattaccctcagtagcagaactaggtggactacgtcttactcctttagaatttgaaaaggacgatgacaccaatttccacatggactttatagttgctgcttcaaatcttcgtgcagctaattacaaaataccgcctgctgatagacataaatcaaaacttattgctggtaagattattcccgccatagcaacaacaacctcagtagttgctggaatggtttgcttggaactctacaaactcaccagaagctatacatccctaactccattcaaaaataatttcattaacctcgctctgcctttcttcagttgctcagaacca

SEQ ID NO: 262 - DNA, 21 bp, Artificial Sequence
  primer
  misc_feature (1)..(21): forward primer
gatcccctgcacttggattat

SEQ ID NO: 263 - DNA, 22 bp, Artificial Sequence
  primer
  misc_feature (1)..(22): reverse primer
tggttctgagcaactgaagaaa

SEQ ID NO: 264 - DNA, 4199 bp, Diabrotica virgifera
  misc_feature (1)..(4199): WCRW transcript ta05794.001_diavv
tgagaacttgcgtggttcatttctttcctttgtcccatcattctgattcattttcagcttaatttttccatgtagtgccggttaattgaagtgatatatgatttatttatgtgattacatctaacagcagactcataaaattgtgtctttttgtgtccgatgtctagtggtagtttagcagacaactccatcgatcctccagccaaaaagcggaagcttgaatcaaagattgctaccctcgaaatggcgaacaatgaagcttcaggatcctccaccagtgatattgatgagggactttactcgagacaactgtacgttttggggcacgaagctatgcgccgcatggcaaatagtgatgttctaatatcaggtttaggtggtttgggtgtagaagtagctaaaaatgtaattcttggtggtgttaaatctgttacccttcacgatgaggctctttgtactattaaggacctgtcatcccaattttatttaacagagggggacattggtaaaaaccgcgcagaagcctgctgtaagcagttatctgaactcaacacttatgtccccacaaagtcttacacagggccccttgatgaagctttcatcttaaagttcagtgctgttgtcttaaccacaagcaatcgtgaagagcaactaagaatcagtgagataacacacgaaaacaacattgcattaattatagcagacacgaaaggcctttttgcacaagtattttgtgatttcggaaaatcctttactgttgtagatgtaaacggagaacctttagtctctgcgatgatagcagacatttcgaatgatgtcgaaagtgtagtcacttgcattgacgatacaaggcatggtatggaggatggagactatgttaccttctcggaagttcagggaatgactgaattaaataactgtgaaccaatcaaaatcaaagtattaggaccatacacctttagtattggcgataccaccaagttttctaaatacaccagaggtggtattgtaagtcaagttaaaatgccgaaacatctggaattcaaatcgtttaaagattctcttgaaaatcctgagataccaattactgattattcaaaaatggattttcctacgcagcttcatctagcttttaccaccttacataagtttgtagaaaagtctgcaaggctacctaaaccatggaacaatgaagatgcaacagaatttgttaatttagctaaatcgttagctgcaaagggtgattctgaaggagaagttaatgtagaccttttagacacatttgccaaggtatcggctggagatttaaatcctataaatgctactattggtggtattgtagcccaagaagtaatgaaggcatgttctggaaaattccatcccattttccaatggttctactatgatgccatagaatgcctaccacaagataaatcagaaatcactgaagaactagctgcacccactggtagcagatatgatggccaagttgctgtttttggaaaagaattccaaaagaagttagcatcactgaaatattttattgttggtgctggagctattggttgtgaattgttgaagaactttgctatgatgggtgtaggaacacaaggagaagttacagtaactgatatggatttaattgaaaaatctaatttgaacaggcagttccttttcagaccacataacgtccaacaaccaaaatctgccacagctgcaaaggtcattaaaaagatgaatcctgatatcaatgttgttgcacatgaaaatcgtgttggacctgaaactgaaagtgtctacaatgacgatttctttgaaaagcttgatggagttgctaatgcactggataacgtagatgctagaatttatatggatagaagatgtgtctactaccgcaagcctcttctagagtctggaaccctaggaactaagggaaatactcaagtggtggcacctttcctctctgaatcatacagttcttctcaagatcctccagagaaaagcattccaatctgtactttaaagaatttccctaatgctatcgaacatactctacaatgggcaagagatatgtttgaaggattgtttaaacaaaatgccgaaaatgcttcgttgtacataacagaccctgatttcctcgataggactgttaagctacctggtgtacaacctttagaggtattggaatccgtaaaggctgccttaattgatgagagacctaaagatttaaatgattgcatcgcttgggcacgtaaccattggcaagaacagtattccaaccaaattaggcagttgttgttcaactttcctcctgatcaattaaccagtacggggcagttgttctggtcgggaccgaagagatgcccagaagcgcttacttttgacgtaaacgatcccctgcacttggattatgttattgctgcagctaatttgaaggctgaagtttatggtataccaactagtagaaatagagaacaaatcgcagaagtggttatgcaagtcaatgttccagaattcatccctaaatctggcgtaaagatagcagttacggattctcaaatggctatgaatggtaataatgtggatttggatcgtgtttcccaaattaaagaagaattaccctcagtagcagaactaggtggactacgtcttactcctttagaatttgaaaaggacgatgacaccaatttccacatggactttatagttgctgcttcaaatcttcgtgcagctaattacaaaataccgcctgctgatagacataaatcaaaacttattgctggtaagattattcccgccatagcaacaacaacctcagtagttgctggaatggtttgcttggaactctacaaactcaccagaagctatacatccctaactccattcaaaaataatttcattaacctcgctctgcctttcttcagttgctcagaaccaatcgcagcccaacaaatggaatactgtggtaacaaatggacactctgggaccgcttcgacgttcagggagagatgacacttagtgaatttttggaatacttcaaggaaaaacacggtcttgaaattacgatgttgtcccagggcgtctgcatgctgtattcgttcttcatggcaaaagctaaagctcaagaacgtttcggtctttcgatgtcagaagtcgtcagacgggtgtcaaagaagaaaatcgaacctcacgtaaaagcattggtattcgaactgtgttgcaacgattccactggtgaagacgtggaagttccatatgttaaatacaatttatgttgagccgactcagttcaaaactcaacttaaaagacttaagagttttgttaggtcagtttctggattaagagtacgggaaaactagccacgttttactatttacacattgtgagattgctgaccaatagttggaatacatattagcagcaagagcttgtgtcttttattatttattatttatcagctgttttttaatatttgcagacctttaaatattttttataacttttaaatgtcctttttgtattaacgtcatggcaaccactgttagtatttaacccttccagctccgctgtaatatgtccagcatcatgacgcacttacgcgtcaaatacactggccaagtcatctttggacgcgcgtatgcgtcaccgtagctgaaagagttaaatctctgtaatttctccaattttcgtttacccaaaaactgatctatactgaatttgggtacttgactggaaagtgtgatctaaattattcttctcaaagaaattgtttgctgtcattttgagataggttaatgaaattaataacggaaaggattagcatttaaacacgttgatgcaatatacttataataacttgtaggagtatgtttatttttatgaaaatagtagttttcaggtaacagttattattttcttaagaaattttcatgtgtgagaataaaataaatatttacaaaaagttccttgttttccttatatacctacaatcgtcgacgactgtagctcaacaacaatatactaagtcgattctatgctccaacaacattttcatttttaaaaatgataaaacaccaaaagtacacatttgttctcatcttactaaggcacgtcgaataatatatcgcttatactatttcagtgacttaaaacgtaagaacagtaaacgtaacagtaagaaattttcatgtgtgagaa

SEQ ID NO: 265 - DNA, 644 bp, Diabrotica virgifera
  misc_feature (1)..(644): RNAi target sequence
gaatttgatttggcattttggtatgtagaaataaaattatcttgtcaataaataatcagaaatattgaaagtagaatcgttctaaataattagaaattgaaagtagaacagtttgttcgttttactaggtagtaaagagttaaatagacaacaggacgctgttaaaaggtaagctattgccgccatacttttcctgactgaatttattaattttttgtttacctaaaaacattattgtttttaaacacattttgtttttgataacatatttaatctaatactagaaaagccaaaaattacaaaataaggtaaagaatctaaatggtttattactattagggcccccaggcattaggcagtctatgtacatgtaacagccagagccaattcgtgggcaagttgtatccttcaagggatgtagaagtgcaagaggtcataattatttactatttctctcgtagaaaactcaacatataagcatcgaattcaaattcagcctcttcttttataacatcacttgaaaggcatttcaattatattttggaagcatgtttgtaggttcccagatatacaaaaatgtcagttcaatcgtttgataatcttctgtataaattaattcaatcaaggccactgatactcctatg

SEQ ID NO: 266 - DNA, 22 bp, Artificial Sequence
  primer
  misc_feature (1)..(22): forward primer
gaatttgatttggcattttggt

SEQ ID NO: 267 - DNA, 22 bp, Artificial Sequence
  primer
  misc_feature (1)..(22): reverse primer
cataggagtatcagtggccttg

SEQ ID NO: 268 - DNA, 712 bp, Diabrotica virgifera
  misc_feature (1)..(712): WCRW transcript ta41459.001_diavv
tcagccagatctatccccaatgtttttaaaatgatttttgatactgaaaaattaaaattaattcacataggagtatcagtggccttgattgaattaatttatacagaagattatcaaacgattgaactgacatttttgtatatctgggaacctacaaacatgcttccaaaatataattgaaatgcctttcaagtgatgttataaaagaagaggctgaatttgaattcgatgcttatatgttgagttttctacgagagaaatagtaaataattatgacctcttgcacttctacatcccttgaaggatacaacttgcccacgaattggctctggctgttacatgtacatagactgcctaatgcctgggggccctaatagtaataaaccatttagattctttaccttattttgtaatttttggcttttctagtattagattaaatatgttatcaaaaacaaaatgtgtttaaaaacaataatgtttttaggtaaacaaaaaattaataaattcagtcaggaaaagtatggcggcaatagcttaccttttaacagcgtcctgttgtctatttaactctttactacctagtaaaacgaacaaactgttctactttcaatttctaattatttagaacgattctactttcaatatttctgattatttattgacaagataattttatttctacataccaaaatgccaaatcaaattcccc

SEQ ID NO: 269 - DNA, 629 bp, Diabrotica virgifera
  misc_feature (1)..(629): RNAi target sequence
  misc_feature (568)..(568): n can be any nucleotide
  misc_feature (594)..(594): n can be any nucleotide
tgagaaaaactgtcctttgcatttgcagcgttaaagatcggtctcagtaataaaattatttgtagagtttgcaatttcctgaaaatagtgacctctgataaagttcacaacagttcaataattggtagtggcgcatatcagtgtctttgacgaagccatgattaatatagctggtggtgcagtgatttcttcgtttgcggtgtatttgttattaagatacaggactagaatgacgtcccttttgacatggattattggaaatattagatctcaacaagctgtcagcagtacatcacaagaagaagagaaatctgacaaatccagcagcaataaacccaagcaacagtttaaaggtggcaaagttcgacagaggcctaaaaaacttaacgaagatcccacatttagtacaagtttatcaacccccattgaagatataatagaggaaacaatcaatgaagaagcagtagcagttaataagaaaaaaggaaaatcatccaaaaagcaaactgaagaattgccagtgaaaaaggaaaaacccacaaaagatctagatgatgacataggttantcatttttcaaagttaaaactgtttnccaaaggaaatccagaagccaagcctaagaaacaa

SEQ ID NO: 270 - DNA, 22 bp, Artificial Sequence
  primer
  misc_feature (1)..(22): forward primer
tgagaaaaactgtcctttgcat

SEQ ID NO: 271 - DNA, 22 bp, Artificial Sequence
  primer
  misc_feature (1)..(22): reverse primer
ttgtttcttaggcttggcttct

SEQ ID NO: 272 - DNA, 1750 bp, Diabrotica virgifera
  misc_feature (1)..(1750): WCRW transcript ta03339.001_diavv
  misc_feature (633)..(633): n can be any nucleotide
aaaagtagcgaaggtacaacgtgtagagaatagtcagtctgagaaaaactgtcctttgcatttgcagcgttaaagatcggtctcagtaataaaattatttgtagagtttgcaatttcctgaaaatagtgacctctgataaagttcacaacagttcaataattggtagtggcgcatatcagtgtctttgacgaagccatgattaatatagctggtggtgcagtgatttcttcgtttgcggtgtatttgttattaagatacaggactagaatgacgtcccttttgacatggattattggaaatattagatctcaacaagctgtcagcagtacatcacaagaagaagagaaatctgacaaatccagcagcaataaacccaagcaacagtttaaaggtggcaaagttcgacagaggcctaaaaaacttaacgaagatcccacatttagtacaagtttatcaacccccattgaagatataatagaggaaacaatcaatgaagaagcagtagcagttaataagaaaaaaggaaaatcatccaaaaagcaaactgaagaattgccagtgaaaaaggaaaaacccacaaaagatctagatgatgacataggttattcatttttcaaagttaaaactgtttnccaaaggaaatccagaagccaagcctaagaaacaagtttctgttgacctaaatgaagataacacagcagatgatataggtttctcatttttacctgtcaaagaaaaaggcaaaaaatataaatctaagagtaatccagaaaataaagaccaagaactgactttaaacgcagtggtagatcagacactgaggaaagctaaatatgatacatcaaagccgtcaagaatagaacattacaaaaagagaacaactgacaaagctttttccaaaaaaggctgcaacaaaatttgaaagtccttcagtatctacaatcgtagaaaagagattgttgtatgaaagcaaacttaaaagtgaaactaaggagagcaaaaaagttacatcttctatttcctttgctagcatagtcagtaatgctactgacgccccttcaggttctgatattgaacaaaattcccagttactaaatggacctaagcctgatattcaacagcatatctttgagtctttagagtcagtaaaatctagtgctgagtccgtagaagtaattgatgatagcaattctgaatatcaaaacagtcaatccaccaattttgagacaatcaaagaaaaattaaatactttactcgatgaggattctgattttaatcaaactcaaatagagcaatcaaatgtatatgaaatagatcaatcttcaaagcattcttctgtatatattgtaggaagtaacgaggtattggaagaatcatcctccacacaagattcttatattggtcatacaggttttgaacaagaacctgaacaaacattcagtcagaaaactctagaagcttctatagacaacagatttataacagatgccagtatattagaaaaaagtacatccactgaagcttttcttagttttgaaagacatatcgaatcacaagatctaacacacagtcttgaatccagtaattattatcaaaataattattcacagttaaattttgacaatcaacttcaaaactcttcagaaagccatatttctgattacagctattcccaaaatcaacagtccctaagctcaagcgacttttctagagactacaattctacagaccattcctttacagaactag

SEQ ID NO: 273 - DNA, 700 bp, Diabrotica virgifera
  misc_feature (1)..(700): RNAi target sequence
  misc_feature (608)..(608): n can be any nucleotide
gagagcacttttcgcagttaccacagcggaccggcttttcaacaaacagaaacaatcagaggaccggtgtaaaagtgatggatccttcatttgagaatgctgggcaagtggatggccttgaaatatggagaattgaagacttcaaacctgtgccttatcctaaaaatcaatacggcaaattctacacaggagactcatacattatactaaataccaaaactacaagaagtggtgccaaagtacatgatcttcatttttggttaggtgctgaaactagccaggatgaacaaggatcagctgccatatatacagttcagttggacgagcatttgaacggagaaccagtccaacatcgtgaaacccaaaaccacgaatctcaactgttcttatcttacttcaaaagcggtggtattcgataccttcctggtggtgttagctctggcttccaccatgtcgatcctaatgctttcgagaagaggctgttccaagttaaaggctctagaaatattagagttaagcaagttaccccatcaatcgcctctatgaacactggtgactgctttattttggacgttggaagagatatttatgtctatgttggtactaanggctagaagagttgaacaactcaagggctattaatgctgccaaccaaattcgcgaccaagatcatgccggaaaggccagagtaaccattgtc

SEQ ID NO: 274 - DNA, 22 bp, Artificial Sequence
  primer
  misc_feature (1)..(22): forward primer
gagagcacttttcgcagttacc

SEQ ID NO: 275 - DNA, 22 bp, Artificial Sequence
  primer
  misc_feature (1)..(22): reverse primer
gacaatggttactctggccttt

SEQ ID NO: 276 - DNA, 2169 bp, Diabrotica virgifera
  misc_feature (1)..(2169): WCRW transcript ta00090.001_diavv
gggggactagctgtatgagctttcgtaacgttcggttgtgtgacagttcagtgtggaagtgataattcaaaaaaaaacgcaggcgacaaaaacaaaataggaactacataatagagagagaccgaggcgaataagatggaccacccttaaaccacccaaattagaacattaaaaggtgtttttcaaagctctcaaattcaatagctagcgcatgtccaaaatgtggggaaacggagcgtttagtcgcggcactttggtgtgtctcgcgcttttagtttatctgaaagatagtagctgtgtgactacaaacagacgagagcacttttcgcagttaccacagcggaccggcttttcaacaaacagaaacaatcagaggaccggtgtaaaagtgatggatccttcatttgagaatgctgggcaagtggatggccttgaaatatggagaattgaagacttcaaacctgtgccttatcctaaaaatcaatacggcaaattctacacaggagactcatacattatactaaataccaaaactacaagaagtggtgccaaagtacatgatcttcatttttggttaggtgctgaaactagccaggatgaacaaggatcagctgccatatatacagttcagttggacgagcatttgaacggagaaccagtccaacatcgtgaaacccaaaaccacgaatctcaactgttcttatcttacttcaaaagcggtggtattcgataccttcctggtggtgttagctctggcttccaccatgtcgatcctaatgctttcgagaagaggctgttccaagttaaaggctctagaaatattagagttaagcaagttaccccatcaatcgcctctatgaacactggtgactgctttattttggacgttggaagagatatttatgtctatgttggtactaaggctagaagagttgaacaactcaaggctattaatgctgccaaccaaattcgcgaccaagatcatgccggaaaggccaaagtaaccattgtcgatacctacagtccagaaagtgactatactacattctttgaagccttgggtgaaggttccagagactcagttcctgactataccaccagtgacgacgatgaatctttcgaacgcacagaggaaaatcatgcttcactttacaaggtatcagatgctactggctctgttaaagtaaccaaagttggacaaaaacctttggaagctagttcattggaccccagcgactgctttattttggataccactgatgccttattgtatgtatggatcggcagcaaatgtgatgaaagagaaaagaaggaagcgatgaataaagctgatgggttccttaatgcgcacaatcaccctaaatggacacatgttcaaagaattgttcaaggagctgagcctactgcgtttacacaatatttcagaaattggcaggcctttggagaaacccacccaagattactacgttctgtcagcacctcagcccacctttaccattgccaaatccgttcaagatctcgcagacttaaagtcgaagagattagggactatgagcaggaagacctctgggaggatgacatcatggtcttggacgctggtgatgttgtgtttgtttggaacggcaaaggagcttcagatgaagaaaaatctagaggacctaaatacgtacataaaatgttgaatcgtcaaggtcgtgaagacgtaccagtaaaaataatcgagcaaggtgatgaaccagaagaattcacaatacacttcccagcttggtcagcagatcactgggacaatttaccagatgtaagaagctacatcaaaaatgaggaagactgaattctgttatcatgattgaccaacgcgtcacttgttttaaataaggcttttaagttgaaaaatgtgcgcaaaaatattatagctttaacatttttaaatatgcatttatatagctgttttagttttttatatgccaatgctctcggttaaatagaaatagtttcaaaattattgttacaacactagaaagaacttatgaattgtgcctaaaaaagatttttaaatactatatttaaatgatactttatatatgtactgttgtgtacctatcagtgttattttttaaaatgtatttgttaagcttgtgtggttacaaaaactataataaaaatattaat

SEQ ID NO: 277 - DNA, 608 bp, Diabrotica virgifera
  misc_feature (1)..(608): RNAi target sequence
  misc_feature (561)..(561): n can be any nucleotide
  misc_feature (562)..(562): n can be any nucleotide
caacctggaactttaactgctgcagctgcaacaccaggtaaaggtaagaagaaggaagaaaagaaacaagagaagaagccacaaacacctaaagaaaagaaggaaaaggaacagccagaagaattagatgctgcagaagccgctcttgctgaagaacccaagagtaaggaccctttttctgaactacctaaaggaacctttgttatggatgactttaaacgtgtctattcaaatgaagaagagagcaaatcaattgcttatttctgggaaaaattcgaccctgaaaactattcaatctggtatggtgaatacaaataccctgaagagctctccaaagtgttcatgagctgtaacctaattactggcatgcaacagagactagataagatgagaaagcaggcctttgcatctgtatgcctttttggagaagacaacaacagcacaatctccggtatctgggtatggagaggacaagaattagcttttaccttaagtcccgactggcaaatagattatgaatcctatgaatggaagaagttagatgccaaatcagaagaaacnngaaattagtagagcaatacttctcatggacaggtactgacaagcaa

SEQ ID NO: 278 - DNA, 22 bp, Artificial Sequence
  primer
  misc_feature (1)..(22): forward primer
caacctggaactttaactgctg

SEQ ID NO: 279 - DNA, 22 bp, Artificial Sequence
  primer
  misc_feature (1)..(22): reverse primer
ttgcttgtcagtacctgtccat

SEQ ID NO: 280 - DNA, 1508 bp, Diabrotica virgifera
  misc_feature (1)..(1508): WCRW transcript ta20625.001_diavv
ggggctctttagctagttttgagtgtagtgagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgcaatggattggctttgctgaaggtgaaattgttccagcagcatgtgcctgggtattccctatcttgggaattgttaaaaataacagtggtaatgatgagactttccaaagagcaaaggaagaccttaaatcctctttgtctattctcaacagccacttacttgcccacacttacttggtaggagagagaatcactctagctgacattgtagttgcctgcaacctattgaatgcctacaaatatgtacttgatcccaactttagaaaatcttttggtaacgtcaatagatggttcaatacacttattaaccagccacaattcatagctgtacttggagaagttaaactttgcagtgcagttgctcaacctggaactttaactgctgcagctgcaacaccaggtaaaggtaagaagaaggaagaaaagaaacaagagaagaagccacaaacacctaaagaaaagaaggaaaaggaacagccagaagaattagatgctgcagaagccgctcttgctgaagaacccaagagtaaggaccctttttctgaactacctaaaggaacctttgttatggatgactttaaacgtgtctattcaaatgaagaagagagcaaatcaattgcttatttctgggaaaaattcgaccctgaaaactattcaatctggtatggtgaatacaaataccctgaagagctctccaaagtgttcatgagctgtaacctaattactggcatgcaacagagactagataagatgagaaagcaggcctttgcatctgtatgcctttttggagaagacaacaacagcacaatctccggtatctgggtatggagaggacaagaattagcttttaccttaagtcccgactggcaaatagattatgaatcctatgaatggaagaagttagatgccaaatcagaagaaacaaagaaattagtagagcaatacttctcatggacaggtactgacaaacaaggtagaaaattcaatcaaggaaaaatctttaaatgatctacatctatttaataaatcttacaaaatgctgtactgatcatgtgaagcaagagaaataaatcccaatgttttgttaataatatttttttattaatatgtaattgttttgatcgaagcttattctttgggctttactccctgagtttataagacacttaaataaatttaataacaatttaaaaaaa

SEQ ID NO: 281 - DNA, 724 bp, Diabrotica virgifera
  misc_feature (1)..(724): RNAi target sequence
gtcagtgtcatcatttgacgtgtcaagtttggggttaaattttgttaatttcaagaattaaaatatttaacataaaaatggtttctatattaaattcaatagatactggtcatgaagatatgatacatgatgcagaagtagattattacggtttaaggttagccacttgttcctcagataacagcatcaaagtttatgatataaaaagtggagcttccacactactggatgatctaaaaggccactatggacctgtttggcaaatagcttggagtcatcctaagtttggcaacttattagcttcgtgttcttatgataggaaagtaataatttggaaagaacagcaaagaaaatggataaaatattatgagtatgcaaatcatgattccagtgttaactctgttcagtttgcacctgctgagctaggtttaattctggcttgtggaagtagcgatggttcaatttctcttttaacttataatgttggaagtaatatttgggatgccaagaagattcaaaatgcccatgcaataggatgtaatgctgtaagttgggctccagccataacccctgtttttggagatgagactacacctgtgaaacgtcttgtttctggaggatgtgacaatttagtaaaaatatggagggaagatggtgacaggtggattgaagagtccaaacttgaagtacgctctgattgggtaagagatgtagcttgggctcc

SEQ ID NO: 282 - DNA, 22 bp, Artificial Sequence
  primer
  misc_feature (1)..(22): forward primer
gtcagtgtcatcatttgacgtg

SEQ ID NO: 283 - DNA, 21 bp, Artificial Sequence
  primer
  misc_feature (1)..(21): reverse primer
gagcccaagctacatctctta

SEQ ID NO: 284 - DNA, 1151 bp, Diabrotica virgifera
  misc_feature (1)..(1151): WCRW transcript ta06970.001_diavv
gggggacagttgtcggcggcccgcagccaaaatccatgttacgccgagacgttcgtatttgacgtgtcaagtttggggttaaattttgttaatttcaagaattaaaatatttaacataaaaatggtttctatattaaattcaatagatactggtcatgaagatatgatacatgatgcagaagtagattattacggtttaaggttagccacttgttcctcagataacagcatcaaagtttatgatataaaaagtggagcttccacactactggatgatctaaaaggccactatggacctgtttggcaaatagcttggagtcatcctaagtttggcaacttattagcttcgtgttcttatgataggaaagtaataatttggaaagaacagcaaagaaaatggataaaatattatgagtatgcaaatcatgattccagtgttaactctgttcagtttgcacctgctgagctaggtttaattctggcttgtggaagtagcgatggttcaatttctcttttaacttataatgttggaagtaatatttgggatgccaagaagattcaaaatgcccatgcaataggatgtaatgctgtaagttgggctccagccataacccctgtttttggagatgagactacacctgtgaaacgtcttgtttctggaggatgtgacaatttagtaaaaatatggagggaagatggtgacaggtggattgaagagtccaaacttgaagtacactctgattgggtaagagatgtagcttgggctccatcagtaggactccacagatataccattgccagctgttctcaagacaggagagttgttatatggactagcaatgattgcatcaattggaattcaacagtcttacatacatttgatgatgtagtttggaatcttagttggtctttgaatggaaatattttagctgtatctggtggagataataaaattaccttgtgggatcaaaactcagaaggtagttggcaatgcattagtgatattgccaagggccaaggtcaaatcaataatcaatgaattcgctatttaaatagatttcgaaagtgttatattttgcattttcttctgtattaagttttaatgaatgtatattttactactctaattttaaaattaaattaataaaaat

SEQ ID NO: 285 - DNA, 501 bp, Diabrotica virgifera
  misc_feature (1)..(501): RNAi target sequence
tgtccaataatgtgtgttgtgaagtgtaacaaatatgaaaaagactacacttagaatatgagttaaaattggttgaagattcctttgtatttagtttgtagttacacaacagtacagacatggcaagggagcaggtaaccagaaaatgggaaatatttcaaggtagaaataggttttactgcaatggaaggctgatgacagcaccgcattctggggtatttttgttgacacttttttttaattactgtaacgagtgtgttattttttgtatttgactgtaaatatttagcagaaaatgtgacaatagccattccgatcatcggagctttgctgttcttatttacagtgtcttcccttttgcgtacaagcttgtctgacccaggtattatacctagggcgtcgtcagaagaggcagcctacgttgaaaagcaaatagaagtaacaaactctgccaacagtcctacatatagaccgccacccaggacgaaagaagttttggtt

SEQ ID NO: 286 - DNA, 23 bp, Artificial Sequence
  primer
  misc_feature (1)..(23): forward primer
tgtccaataatgtgtgttgtgaa

SEQ ID NO: 287 - DNA, 22 bp, Artificial Sequence
  primer
  misc_feature (1)..(22): reverse primer
aaccaaaacttctttcgtcctg

SEQ ID NO: 288 - DNA, 2197 bp, Diabrotica virgifera
  misc_feature (1)..(2197): WCRW transcript ta06058.001_diavv
gggggtcaaagtcaactgtcaaaattgttgagtcgtgaatgtcggataatcttcactttttaggagtgtttcttgtttatttgtaaaaaacgataatatgcgtatctctaaacaagatgatatattaaattctgtccaataatgtgtgttgtgaagtgtaacaaatatgaaaaagactacacttagaatatgagttaaaattggttgaagattcctttgtatttagtttgtagttacacaacagtacagacatggcaagggagcaggtaaccagaaaatgggaaatatttcaaggtagaaataggttttactgcaatggaaggctaatgacagcaccgcattctggggtatttttgttgacactttttttaattactgtaacgagtgtgttattttttgtatttgactgtaaatatttagcagaaaatgtgacaatagccattccgatcatcggagctttgctgttcttatttacagtgtcttcccttttgcgtacaagcttgtctgacccaggtattatacctagggcgtcgtcagaagaggcagcctacgttgaaaagcaaatagaagtaacaaactctgccaacagtcctacatatagaccgccacccaggacgaaagaagttttggttaaaggtcaaaccattaaacttaagtattgcttcacttgtaaaatatttaggccgcctagagcttcgcattgtagtttatgtgataattgtgtagataggtttgatcatcactgtccatgggtggggaactgtgttggtagaagaaattataggtttttttacatgtttatagtatcactggcgtttttagcagtatttatatttgcctgtgcagttgcgcatcttattttaatgacgaaggaagatcgagaattcctagatgccgtgaaggaatcccctcccagcgtgctagttgcagtcatttgtttttttagtgtttggagtattttgggcttggccggattccatacgtaccttacggctagcaaccaaaccactaatgaagatataaaaggatcttttacaagcaaaagaggccaagaaaacgtcaacccttattcggagggcaacgtctgcttaaattgttttcacattctctgtggaccggttactccttcgttaatcgacagaagaggtgttgtcacagaaagctaccaatacgaaaacagtagacctgttaccaatgcaccaactttgcctttgaagaaatatggattgcccttgcagaatggtccccaacaagtgacacctgacgcagcggaaatgccaggcatctaccgccaaaccaccgagaacacggaaagcaacacgggtagcgtaacccacttagtgtctagcgaacagcccctagccgtcgttcccgccgcagtgcatctacagagaacccacggggacttgcaacagtaccagtcgcagaccagtctgaaccactccccggtctacaacaacatcaccccaacgcacgccgctcccgcgcaactcagcaaatcacaaagctgtatcgacaatataaattccacgtcttcatcgaaagaaaacggcgcgaaagacattacattgaacatggaagacctccatttggatcctgtgatattgagggagaaccacgtactggtcaacatcaacgacaaaggacggctcgccgatttgaggctagacaacgatatgacagtgcaagacaaggagaacagtttgttgagtgttagtaggttgcgactgttgcaagacacgacgatgatcgagagtgctttagacttggattcgttagatgggtctagtttaggtacgaatagtcaggcgggattgatgaaagtagacgtgtagttcattcgagaacttttagaagagaatgtttgtcatttgtttggcaacagccaacatatagtagtattgaatacagaagaacgtaaaataactcatgatagtgcaataaaatgggatttctttgttttcgacttattttattggtcaaaagttttgtttatatttttataacagaataaatatgattaaataattgatttgcactttaaaatgtataaaaatcatcagcagatttatctgtagcaatgcaagacacttttatagtaatctccagctagggaaaacttacgcagtgcatcttagtatttcagaattaaattttaaatgaaaaagacctttataaaagatatatttattttaaa

SEQ ID NO: 289 - DNA, 628 bp, Diabrotica virgifera
  misc_feature (1)..(628): RNAi target sequence
aatttgtgcctcggaattgtattttttacgttttttagtggaatttgggcttcagccgaaaaaataccactgggagcaattttcgaacagggcacagatgacgtccaaacagcatttaaatttgcgatgttgcagcacaatcaaaatatttccagtagaaaatttgaatttcaagcatatgttgacgttattaatactgcggatgcatttaaattgtctagattaatttgcactcaattttcaagaggtgtatattcgatgttgggagcagtttctccagattcatttgatacgctacattcctatagtaatacttttcaaatgccttttgtaacgccttggtttccagaaaaagtattagccccgtcatcgggatttatggactatgctatttcaatgcgacctgaataccacaaagccatcatagatacggttaagtattacggatggaggcagattatatatttatatgattctaatgatggtctcctaaggttacaacagatataccaaggattaactcctggcagtgagatttttcaagtcactactgtacggagaataaacaatgttagcgaagcattatcatttcttagaggaatagaagaacatactcgatggaccaaca

SEQ ID NO: 290 - DNA, 22 bp, Artificial Sequence
  primer
  misc_feature (1)..(22): forward primer
aatttgtgcctcggaattgtat

SEQ ID NO: 291 - DNA, 22 bp, Artificial Sequence
  primer
  misc_feature (1)..(22): reverse primer
tgttggtccatcgagtatgttc

SEQ ID NO: 292 - DNA, 690 bp, Diabrotica virgifera
  misc_feature (1)..(690): WCRW transcript ta41486.001_diavv
gatcacgtcatgggcaccacaaatttgtgcctcggaattgtattttttacgttttttagtggaatttgggcttcagccgaaaaaataccactgggagcaattttcgaacagggcacagatgacgtccaaacagcatttaaatttgcgatgttgcagcacaatcaaaatatttccagtagaaaatttgaatttcaagcatatgttgacgttattaatactgcggatgcatttaaattgtctagattaatttgcactcaattttcaagaggtgtatattcgatgttgggagcagtttctccagattcatttgatacgctacattcctatagtaatacttttcaaatgccttttgtaacgccttggtttccagaaaaagtattagccccgtcatcgggatttatggactatgctatttcaatgcgacctgaataccacaaagccatcatagatacggttaagtattacggatggaggcagattatatatttatatgattctaatgatggtctcctaaggttacaacagatataccaaggattaactcctggcagtgagatttttcaagtcactactgtacggagaataaacaatgttagcgaagcattatcatttcttagaggaatagaagaacatactcgatggaccaacaaatatgtggttctagattgctctactgagactgctaaagaa

SEQ ID NO: 293 - DNA, 710 bp, Diabrotica virgifera
  misc_feature (1)..(710): RNAi target sequence
gctctgttatgtgcgtcaagaatttagaaattttatattatccgtaatggtggtcgaccgtgtgcattctaaaactattaaataatcatgtcgctagagactcgatctaattcagctctgtttaaaagagcagaccaactaaaacgttgggaagaatcagatacaaatcgagaaccagtgtcaccgaaacaaaaaactcggaaaattaaattttcttcgggatgtgtgtttctcgcggcttgtgctgctggtgataaaaaagaagtgttggaattgttacataaaggagctgacatcaatactgcaaatgtggacggattaacagccctacatcaggcatgtatcgacgacaatctcgacatggtggagttcctcgtggagaacggggcggacgtcaacaggggcgacaacgaaggttggacccctttgcacgccactgccagctgcgggtttctctcgatcgcgaagtacctcatcgaaaagggggcccacgtagcggcagttaataacgatggacaattggcacttgatattgccgagagccaaaaaatggaaggactactcagggaagaaattgaggatagaggcatcgactgcgaagcagctaggaacgaagaagaattggtgatgttgagggatgccaaagattggttagcgacaaaaagttccttagttaacgtaccacaccctaaaaacggagctacaccttt

SEQ ID NO: 294 - DNA, 22 bp, Artificial Sequence
  primer
  misc_feature (1)..(22): forward primer
gctctgttatgtgcgtcaagaa

SEQ ID NO: 295 - DNA, 23 bp, Artificial Sequence
  primer
  misc_feature (1)..(23): reverse primer
aaaggtgtagctccgtttttagg

SEQ ID NO: 296 - DNA, 3435 bp, Diabrotica virgifera
  misc_feature (1)..(3435): WCRW transcript ta00860.008_diavv
ttttatattatccgtaatggtggccgaccgtgtgcattctaaaactattaaataatcatgtcgctagagactcgatctaattcagctctgtttaaaagagcagaccaactaaaacgttgggaagaatcagatacaaatcgagaaccagtgtcaccgaaacaaaaaactcggaaaattaaattttcttcgggatgtgtgtttctcgcggcttgtgctgctggtgataaaaaagaagtgttggaattgttacataaaggagctgacatcaatactgcaaatgtggacggattaacagccctacatcaggcatgtatcgacgacaatctcgacatggtggagttcctcgtggagaacggggcggacgtcaacaggggcgacaacgaaggttggacccctttgcacgccactgccagctgcgggtttctctcgatcgcgaagtacctcatcgaaaagggggcccacgtagcggcagttaataacgatggacaattggcacttgatattgccgagagccaaaaaatggaaggactactcagggaagaaattgaggatagaggcatcgactgcgaagcagctaggaacgaagaagaattggtgatgttgagggatgccaaagattggttagcgacaaaaagttccttagttaacgtaccacaccctaaaaacggagctacacctttacatgtagcctgtgccaaaggttatgccgacgttataaaaatattattacaatgtggagctgacattgatgcgcaggatgttgacggctggacccctctacatgcagctgcgcactggggccaaaaggaaacgtgccaaatattggctgaaagtttggctgacatggaagctaaaaacttcgtaggacaaacagcatttgacttgtgtgatactgacatgttatcgacattggaagatcttaaggaaaaaaaaaaaaaaaaaaaaacgaattaatagaagaatggccaagaagagggccgatattaacgataggaatttggaatctgagacgcctaccaaagtgaaaaaggttgagctcgaagggacgaaagtgattagaaatatagaaaagaaaaataacctgaatgccaacaatgaaatcacaacgaacactactgtaccccagaagatcgttgaagacaaagaggatgttactttaaggaagaaaccgtatacaaaacagaattcagatttgagtccaacaaaactgaatagtacgaataatttgactaattccacggaatctataaagattgaaccagaagttactctcaggaaacctcctattgtacaaaatgaaaaaccgactaaaaaagaagacaacgatacaccggtcagtaccgctgcaaccacaaataccacaactaacatatcacaagaaaagacttcaccagtgactagtccacagcctactactaacaaccaacaacaattgcgaagcggtctaaagttgcaaatgccacctccgcctacaacaacggttaccgcccctacaccggtaacgaattcttccacgccctccactcctacaacgccgggaggaaccaggcttcagatgctcaaaaatttctttaagtcgtttgttcctccagtaagggatgaagaaagtgaaactcaaagaaaagcgcatgccaagagggtaagggagactcgacgatccactcagggggtaactttagaagaaatcaaatccgccgaacagttagtaaaacagaagaatcaacctggtggcggcaatgaggaaaagcctggagcaaatggagactcccccaacggaatcgtagttaccgccaccatcacaaccggtactcccacagttataacaactcgtgaaagtgaggaaccacccgcaatacacgaaaggcgaccatcgtggaggttgagggtagacaatggtaccagcaagttcttgttagaagacgcttcaaaaccttcggacccgccaaacacgccgtcgattattcgtaggaccatcgcatccatccaaagaccttcttcagcgcctctagagactgcagatactacaattacactgcctttaagaaaacccaaatccgtagaagaaaaagatcaagataaggagaacgatattagaaatgctcaagcaactctagccacacaagcagctattcaaaggagaagaaggccgaagaggagatcgacaggggtagtttcgtttgataatgttgatgatttggaacaggagaaggattcttcaagtggaaaagactgtgatgatactactaaaatgaatcatttggagagcggcacagaccgaagtagccgatcgagaattggtagttcttcggatattcgaaacgagaacggagaattggactacaaaaaactgtatgaacagcaactcgcagagaacgaccgactgaaagacaaattaaggaaatctgacgaggagttgcgagaaaccaaacaaactttggaaaaaattaacttggtcacaagtaaaaattccttatccgaactagaaaaacgcgaaaggagagccatggagagaaaacttagtgaaatggaagaggaactaaagcaattacaaaagttgaaagctgagaacgaacgcctaaaggccgacaacagatcactcacacgtgtcatcaataaacttaccaactctgcaatgtaatagaatttggaaaatcttaaatccgagaaccagaggttgaaggatgaaaatggtgctcttatcagagtgatcagcaaactgtcaaagtagcataagttttagttgttatcattcatgcattttatgttaaggtgactttaataatttattgttagaaaataatgaaaattcaggatttcccatttttattcacgttgaaagttagtttctttaacacagatttgtagtagttaaattgaatcgtactattgtggacgcgaatgaaaataggacgcgaaaaaaagaatatgaagctgaaatagaggctatcgagatggaaattgtaaagaaaatagcagatgaagaagaagtaacgagatcattaggtatataacaggtcacaaacaataaaagaatatacccagacacaaaaaaataaactaatgtgatcgtagattccagagacaactttaaagtaaatattactagcatccaagaaagatatggatataacacaccatataagagatatatccccgaaaaaaagtaaaactgttaagagaggatctacagtccttatctaaagaaactcaagttgtttaccgagttgtgtactttacgagttttttgcgtacttagaggttttttataaactgtacagaagtaaacaaatacttcataaaaacgtttctgtggggattgatactcggctattttaaatatatttattaaataaatacatgtttttttgtttatacctcataaaagtcattcttatgatccaaaaaaaacaaacaatccatttggcatacttattt

SEQ ID NO: 297 - DNA, 632 bp, Diabrotica virgifera
  misc_feature (1)..(632): RNAi target sequence
  misc_feature (610)..(610): n can be any nucleotide
ggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattgttaaacatgcttttgaaattatccatttactaactggagaaaatccattacagattttagtttctgctattatcaattcaggacctagagaagattctactcgtattggtagagctggtactgtaagaagacaagctgttgatgtgtcacccttgagaagggttaaccaagcaatttggttgctctgcacaggtgctagggaagcagcattccgtaatattaaaactattgctgaatgtttggctgatgaattaatcaatgctgccaagggatcatcaaattcatatgctatcaaaaagaanggatgaacttgaacgtgtagcc

SEQ ID NO: 298 - DNA, 21 bp, Artificial Sequence
  primer
  misc_feature (1)..(21): forward primer
gacagtatggaagacgattgg

SEQ ID NO: 299 - DNA, 22 bp, Artificial Sequence
  primer
  misc_feature (1)..(22): reverse primer
ggctacacgttcaagttcatcc

SEQ ID NO: 300 - DNA, 806 bp, Diabrotica virgifera
  misc_feature (1)..(806): WCRW transcript ta21523.001_diavv
gcacgaggagcgattgccggagtggaagtcgctctcaaaaaaagagaaaattagaaaagcaaccttttccggttcacgccgtcgttcagcaagagcttgcgatttttatttttgaaaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattgttaaacatgcttttgaaattatccatttactaactggagaaaatccattacagattttagtttctgctattatcaattcaggacctagagaagattctactcgtattggtagagctggtactgtaagaagacaagctgttgatgtgtcacccttgagaagggttaaccaagcaatttggttgctctgcacaggtgctagggaagcagcattccgtaatattaaaactattgctgaatgtttggctgatgaattaatcaatgctgccaagggatcatcaaattcatatgctatcaaaaagaaggatgaacttgaacgtgtagccaaatccaaccgttaaatttatttctcatttta

SEQ ID NO: 301 - DNA, 546 bp, Diabrotica virgifera
  misc_feature (1)..(546): RNAi target sequence
caagtagggctaaaatgaagcaaattgtaacaaaccaaacggtaaaaattcctgagggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagtaaactccaccaaacaaaaggatgaacttatcattgaaggaaactcattggaggatgtttcaaagtcagctgcccttattcaacaatctacaacagttaaaaataaggatatccgtaaattcttagatgggcttt

SEQ ID NO: 302 - DNA, 23 bp, Artificial Sequence
  primer
  misc_feature (1)..(23): forward primer
caagtagggctaaaatgaagcaa

SEQ ID NO: 303 - DNA, 23 bp, Artificial Sequence
  primer
  misc_feature (1)..(23): reverse primer
aaagcccatctaagaatttacgg

SEQ ID NO: 304 - DNA, 789 bp, Diabrotica virgifera
  misc_feature (1)..(789): 02181.002_diavv
ggggaaaactcttcggaatagaagtcgctttttctgtccattttatgtcacaagtagggctaaaatgaagcaaattgtaacaaaccaaacggtaaaaattcctgagggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagtaaactccaccaaacaaaaggatgaacttatcattgaaggaaactcattggaggatgtttcaaagtcagctgcccttattcaacaatctacaacagttaaaaataaggatatccgtaaattcttagatgggctttatgtatctgaaaaaacaactgttgtacaagaagaataacttgtatttttgaaataaatttaagtttatatttaaaaaaaaaaaaaaaaaatccgttcaacaatctacaacagttaaaaataaggatatccgtaaattcttagatgggctttatgtatctgaaaaaacaactgttgtacaagaagaataacttg

SEQ ID NO: 305 - DNA, 409 bp, Diabrotica virgifera
  misc_feature (1)..(409): RNAi target sequence
ctcttttgacaacggccaacgttctaaagttgcatcatggcgtcttcagaaggtgcaggcgtgactacaggtcaaccaaatttacacaaacaagatttatctaaattggatgttaaaagattgacggctttatctccagaagttataagtagacaagctaccattaacattggtacaattggacatgtagcgcatggaaaatcgactgtggttaaggccatatctggggtacaaactgtcagatttaagaatgaactggaaaggaacattaccattaagctaggttatgctaacgcaaaaatctacaaatgtgataatccgaaatgccccaggccctcctgctttatttcgggcagttcttcaaaggacgacagtttcccttgtttacgtccagcatgttcgggtagat

SEQ ID NO: 306 - DNA, 20 bp, Artificial Sequence
  primer
  misc_feature (1)..(20): forward primer
ctcttttgacaacggccaac

SEQ ID NO: 307 - DNA, 20 bp, Artificial Sequence
  primer
  misc_feature (1)..(20): reverse primer
atctacccgaacatgctgga

SEQ ID NO: 308 - DNA, 1691 bp, Diabrotica virgifera
  misc_feature (1)..(1691): WCRW transcript ta02330.001_diavv
ggacaagtgacgtgttttcatgaacgttagatgtcaaaattattggccgcctcttttgacaacggccaacgttctaaagttgcatcatggcgtcttcagaaggtgcaggcgtgactacaggtcaaccaaatttacacaaacaagatttatctaaattggatgttaaaagattgacggctttatctccagaagttataagtagacaagctaccattaacattggtacaattggacatgtagcgcatggaaaatcgactgtggttaaggccatatctggggtacaaactgtcagatttaagaatgaactggaaaggaacattaccattaagctaggttatgctaacgcaaaaatctacaaatgtgataatccgaaatgccccaggccctcctgctttatttcgggcagttcttcaaaggacgacagtttcccttgtttacgtccagcatgttcgggtagattccaattggtcagacatgtcagctttgtagattgccctggtcacgacattcttatggctaccatgcttaacggagccgctgtgatggacgcagcattgttattaatagcaggaaacgaatcatgtcctcaacctcaaactagtgaacatttggctgctatcgaaatcatgaagttgaaacacatcctcattcttcaaaataaaatagatttggtgaaggaagggcaagccaaggagcaacatgagcaaattgtgaaatttgtccaaggaactgtagctgaaggagcccctataattcccatatccgctcagttgaaatataacatcgaggttttgtgcgaatatatcactaaaaaaattccaataccaatgagagattttacttctgaaccaaggctgatcgtgatcagatcttttgatgttaataaacctggttgtgaagttaacgatttaaaaggaggtgtagctggtggcagtattttaagaggagtgttgaaggtgggacaagaaattgaagtaagacctggactagttagcaaggactcagaaggaaagctggcctgccgaccaatattctctagaatagtatctctatataccgaacaaaacgaactgcagtttgcagttccaggaggactcattggtgtcggtaccaaaatcgaaccaaccctttgcagagccgatcgacttgtaggtcaagttttgggagcagttggtgctctacctagtatctttacagaacttgaggtgagttactatctattgaaacgtttgctgggagtccgtacagaaggagacaagaaaggggccaaagtccagagattaaccagaagtgaagtactccttgtcaacattggatccctcagcacgggaggacgagttgtagccactaaggccgatttgtgcaagatcgctttaacgaatccagtctgtacggaaatcggcgaaaagattgcactcagtagacgtgttgaaaaacattggcgtctcatcggatgggggcagatccgcggaggggagacaatcgagcctaccacaagctaggctttttatactcgtaccggtcttttcaggacactttaagccaatttttgttttctatttaatatcgttttattaaagaagtgtttacgttttgtttatatcttttaggttgatttttattactgctatagtgtactgattatccgattcaaatataatgtctataaaactaaaaaaaaaaaaaaaaaa

SEQ ID NO: 309 - DNA, 670 bp, Diabrotica virgifera
  misc_feature (1)..(670): RNAi target sequence
attgcagtcattgctgtagtgcacacgtaatttaagtatttatttaagaattgtctgcaaataattaattataagatggctaaagccccagctgtaggtattgatttaggaaccacatactcctgtgtaggagttttccaacatggcaaagttgaaattattgccaacgaccaaggtaacagaaccacaccatcatatgtggccttcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcaggtaaaccaaagattaaagttgcatacaagggcgaagacaaatccttctacccagaagaagtcagttccatggtccttacaaaaatgaaggaaacagcagaagcatacttaggaaagaatgtcaccaacgctgtcatcacagtacctgcatatttcaatgactcacaacgtcaagctaccaaagatgctggaaccattgctggactccaggtattacgtattattaacgaacccactgctgctgccatcgcctatggtttagacaaaaagggccaaggtgaaagaaacgtcctcattttcg

SEQ ID NO: 310 - DNA, 22 bp, Artificial Sequence
  primer
  misc_feature (1)..(22): forward primer
attgcagtcattgctgtagtgc

SEQ ID NO: 311 - DNA, 22 bp, Artificial Sequence
  primer
  misc_feature (1)..(22): reverse primer
cgaaaatgaggacgtttctttc

SEQ ID NO: 312 - DNA, 2609 bp, Diabrotica virgifera
  misc_feature (1)..(2609): WCRW transcript ta00491.010_diavv
  misc_feature (19)..(19): n can be any nucleotide
  misc_feature (49)..(49): n can be any nucleotide
ggcccatggaactgacttnttctgggtagaaggatttgtctttcgcccnttgtatgcaaactttaatcttttggtttaccttgcatcatttattactttcaaatggccaatgtttcatgtcagactgtacagcactgtcatcaaagcgacgcccaataagacgtttggcatcaaaaattgtgttattggggttcatggctacctggttcttggcagcatctccgatgagacgttctgtgtctgtgaaggccacatatgatggtgtggttctgttaccttggtcgttggcaataatttcaactttgccatgttggaaaactcctacacaggagtatgtggttcctaaatcaatacctacagctggggctttagccatcttggggggatttgattgcagtcattgctgtagtgcacacgtaatttaagtatttatttaagaattgtctgcaaataattaattataagatggctaaagccccagctgtaggtattgatttaggaaccacatactcctgtgtaggagttttccaacatggcaaagttgaaattattgccaacgaccaaggtaacagaaccacaccatcatatgtggccttcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcaggtaaaccaaagattaaagttgcatacaagggcgaagacaaatccttctacccagaagaagtcagttccatggtccttacaaaaatgaaggaaacagcagaagcatacttaggaaagaatgtcaccaacgctgtcatcacagtacctgcatatttcaatgactcacaacgtcaagctaccaaagatgctggaaccattgctggactccaggtattacgtattattaacgaacccaccgctgctgccatcgcctatggtttagacaaaaagggccaaggtgaaagaaacgtcctcattttcgatctgggtggtggtacttttgatgtatcaatcttaacaattgaagatggtatctttgaagtcaaatcaactgctggagacactcacttgggaggtgaagacttcgacaacagaatggtcaatcactttgttggagaattcaagaggaaatacaagaaggaccttaccacaaacaaacgtgccctccgtcgtttgagaacaagctgtgaaagagctaagcgtaccctttcctcatcaacccaagccagcattgaaatcgattctctatttgagggtattgacttctacacctcaatcaccagggctagatttgaagaactcaacgctgatttgttcagatctaccatggaacctgtagaaaaggccatcagggatgccaagatggacaaatctcaagttcacgatattgtgttggttggtggatctacccgtattccaaaggtacaaaaactgttgcaagatttcttcaatggtaaagaattgaacaagtcgatcaaccccgatgaagctgttgcttatggtgcagccgtccaagccgccatcttgcacggagataagtctgaggaagtacaggacttgctcttgctcgatgtcactccactctcattgggtattgaaactgccggaggtgttatgactgccctcatcaaacgtaacactaccattcccaccaagcaaacccagaccttcactacttactctgacaaccaacccggagtacttattcaggtatatgaaggtgaacgtgccatgaccaaggacaacaacctcttgggaaaattcgaacttactggcattcctcctgcgccccgtggtgtccctcagattgaagtaaccttcgacattgatgccaacggtatcttgaacgtcacagctattgaaaaatccaccaacaaagaaaacaagatcaccatcaccaatgataaaggtcgtctcagcaaagaagacattgaaagaatggtcaacgatgcagaaaaataccgtaacgaagatgataagcaaaaggctaccatctctgccaagaacgtcctcgaatcatactgtttcaacatcaagagcaccatggaagatgacaaaatcaaggacaagatcagcgaaagtgacaaaactaccgtcatggagaaatgcaacgaggttattgcttggttggatgctaaccaattagccgacaaggaagaatatgaacacaaacaaaaggagctcgaaaacatctgcaaccccatcatcaccaagttgtaccaaggtgccggtggagctccaggtggcatgcccggtggtttcccaggtggagcagctccaggagctgcaggcgccgctggaggtgctggaccaaccattgaagaagtcgattaaactattcattccattttttaaacttttgttaaccgttgtgcagtattacttgcagacaaagctttttaaaattactttttttacacaatttttcaattgttaaacaacgtttttggtaacagttcaaaaattactgcaataattatgttcgttcatgaataaaataaaaagtcaaatccgaaaaaaaaaaaaaaaaa

SEQ ID NO: 313 - DNA, 672 bp, Diabrotica virgifera
  misc_feature (1)..(672): RNAi target sequence
  misc_feature (648)..(648): n can be any nucleotide
  misc_feature (649)..(649): n can be any nucleotide
tacacgtaaaaatggcttcgacgatatcggcaagacaggctaacagagaacatgttttggccgtatccagagacttcatatcccaaccaagactcacttacaaaactgtatctggtgtcaacggtccactagtaatcctcgaagatgtcaaatttcctaagttcaacgaaattgtccaactcagattatctgacggaagtttaagatcaggtcaagtacttgaagtcagcggttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatatccaaggacaacccatcaacccatggtcccgtatctacccagaggaaatgatccaaactggtatcacagctatcgatgtgatgaactcgattgcccgtggtcagaagattcccattttctcagctgctggtctgccacataacgatattgctgcccaaatttgtaggcaagccggtcttgtcaaaatcccaggcaaatcagttttggatgaccacgaagannctttgccatcgtgttcgctgctatgggtgttaa

SEQ ID NO: 314 - DNA, 22 bp, Artificial Sequence
  primer
  misc_feature (1)..(22): forward primer
tacacgtaaaaatggcttcgac

SEQ ID NO: 315 - DNA, 21 bp, Artificial Sequence
  primer
  misc_feature (1)..(21): reverse primer
ttaacacccatagcagcgaac

SEQ ID NO: 316 - DNA, 2583 bp, Diabrotica virgifera
  misc_feature (1)..(2583): WCRW transcript ta00620.001_diavv
tcttaaacttccgtcagatgggggcagttgctaattttttactgtctttgatagacgtctcctgtacacgtaaaaatggcttcgacgatatcggcaagacaggctaacagagaacatgttttggccgtatccagagacttcatatcccaaccaagactcacttacaaaactgtatctggtgtcaacggtccactagtaatcctcgaagatgtcaaatttcctaagttcaacgaaattgtccaactcagattatctgacggaagtttaagatcaggtcaagtacttgaagtcagcggttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatattcaaggacaacccatcaacccatggtcccgtatctacccagaggaaatgatccaaactggtatcactgccatcgatgtgatgaactcgattgcccgtggtcagaagattcccattttctcagctgctggtctgccacataacgatattgctgcccaaatttgtaggcaagccggtcttgtcaaaatcccaggcaaatcagttttggatgaccacgaagacaactttgccatcgtgttcgctgctatgggtgttaacatggagactgctagattcttcaaacaagatttcgaagaaaatggttctatggaaaacgtatgtttgttcttgaacttggctaacgatccaaccatcgaaagaatcatcaccccacgtcttgctctaacagccgctgaattcttggcttaccagtgcgaaaaacacgtgttagtcattttaactgacatgtcttcatacgctgaagctttgcgtgaggtatctgccgccagagaggaagtacccggtcgtcgtggtttccccggttacatgtacaccgatttggccaccatctacgaacgtgccggtcgtgtcgaaggccgtaacggttccatcactcaaatccccatcttgactatgcctaacgacgatattactcaccctattcccgatttgacaggttatattaccgaaggacagatctacgtcgaccgtcaattgcacaacaggcagatctacccaccaattaacgtactgccatctctctcacgtttgatgaagtctgctatcggcgaaggtatgaccaggaaggaccactctgacgtttctaaccaattgtatgcttgttatgctatcggtaaggacgtccaggccatgaaagccgtagtaggtgaagaagctctaacacccgacgatcttctctacctcgagttcctaacgaaattcgaaaagaacttcatcacccaaggaaactacgaaaaccgcaccgtcttcgagtctttggacatcggctggcaactactccgtatcttccctaaggaaatgttgaaacgtatccctgcaagcacattggcggaattctatccaagagactctcgtcactagttggtttatgtataaaatttatatatatttaggaagtttgttaggtttgttacaaatatgtccacttattgtatcgattattttcaattgagagatattttaccaaaacaatttgagccgatgagattctacggtgtaatttttgtaaatacttaaagagcgtgtttcaaaaatgcgcttaatataatatattatcaatacagagcaacctttttttctttattattttttcttgttgaacaatatataaagttcttgaactccctaagtggaacatagagcttcagtgaaaatgcaccatcacctcattccaagactttccttgacttcttaccaattgttggacaattataactcagattaattttactaggtgacagttccataagtaaaaatatgcaatggctatatattgcgtactaaacttaagaagaaaaattgtgtcgctctggaagaaagattacttgcataagaatgaaaatcagtgtcatattttgcgtttatgacatccctagacgatactattttttcgttactatattttttttaaagagatcaagagcaacaatttggagactgatattcttatgcgagttgttttcctactttgtcctattttgaagagtctacaattatttacttaccatttgattaaattagatgaacataagacaatactatatttttatcatgtaagttgatattccctatgtaaattattggcacaatgtaacctccaacttgatttatacatttattttacttttgtttgtctattttttctgtaatagagtggaagaattaacattccattaaatgtcattgcccaatgtataaagcaatatacctcttaccattcgatgctttttcagtattttaattctagatggtgaacggagatttttcttgatgtaggttttgacattttcgatgttactgtaaaaatctaattttatgttaaatagattagtgtacaaaaatgtgaataaacactatacatatgttaaaaaaaaaaaaaaaaaa

SEQ ID NO: 317 - DNA, 500 bp, Diabrotica virgifera
  misc_feature (1)..(500): RNAi target sequence
actttgacgagaggcgttgttagttacttcgttgtgtcgacatttttctgtttagtgtaccgattaatcttcaaatattacaatggctgaccaactcaccgaagaacaaattgccgaattcaaagaagctttctcactattcgataaagatggtgatggtacaattacgactaaagaattaggaacagtaatgagatctctaggacaaaatccaacagaggctgaattacaggatgtgaccaatgaagtagatgccgatggtaacggcacgatcgatttcccagaatttttaacgatgatggcacgtaaaatgaaagataccgatagtgaggaagaaattcgtgaagcattccgagtgttcgacaaagacggcaatggtttcatctcagcagcagaattgcgccacgtcatgaccaacttgggtgaaaaattgacagacgaagaagtcgatgaaatgattcgggaggccgatatcgatggtgatggtcaagtcaattacg

SEQ ID NO: 318 - DNA, 20 bp, Artificial Sequence
  primer
  misc_feature (1)..(20): forward primer
actttgacgagaggcgttgt

SEQ ID NO: 319 - DNA, 22 bp, Artificial Sequence
  primer
  misc_feature (1)..(22): reverse primer
cgtaattgacttgaccatcacc

SEQ ID NO: 320 - DNA, 713 bp, Diabrotica virgifera
  misc_feature (1)..(713): WCRW transcript ta02046.005_diavv
gcagcagcagttcccccctctcttctcttacgtcgatcctaaacaaaacgagaaaagacagttggctggtgcactttgacgagaggcgttgttagttacttcgttgtgtcgacatttttctgtttagtgtaccgattaatcttcaaatattacaatggctgaccaactcaccgaagaacaaattgctgaattcaaagaagctttctcactattcgataaagatggtgatggtacaattacgactaaagaattaggaacagtaatgagatctctaggacaaaatccaacagaggctgaattacaggatatgatcaatgaagtagatgccgatggtaacggcacgatcgatttcccagaatttttaacgatgatggcacgtaaaatgaaagataccgatagtgaggaagaaattcgtgaagcattccgagtgttcgacaaagacggcaatggtttcatctcagcagcagaattgcgccacgtcatgaccaacttgggtgaaaaattgacagacgaagaagtcgatgaaatgattcgggaggccgatatcgatggtgatggtcaagtcaattacgaagagtttattagaagtcacctcttggccaactaagatattattgattacaaagaaaaatagaagaatatattataatttacagatactatattaatgataatagaataagaataaaatgtaaataaatagttttgctcat

SEQ ID NO: 321 - DNA, 514 bp, Diabrotica virgifera
  misc_feature (1)..(514): RNAi target sequence
tttggcaacattgtgtatgatgtcataggagcggggtcagataggaatgttgtagttttgaatgatatacacatagatataatggactatatagtgcctgctagttgtacagatagcgagtttatgagaatgtgggcggaatttgaatgggaaaataaggtaaccgttaacacacccctcacggaactttcagaatacctcgaacatctactcaaaagcacaaatttgaaatgtttaacatcagaaaaagctctgagcgggcagtgtggttttatggcagccaatttatatgcaaaatccatttttggagaagacgctttggccaacttaagtatagagaaaccttttaataaacccgatgcgccagtaagcggtcatattagaataagggccaaaagtcagggcatggccttaagtttaggagacaaagtcaatatgacacagaagagcacacaacataaagtagtagctgcataaataaaaacgtttttttctgtttcaacccttttcttca

SEQ ID NO: 322 - DNA, 22 bp, Artificial Sequence
  primer
  misc_feature (1)..(22): forward primer
tttggcaacattgtgtatgatg

SEQ ID NO: 323 - DNA, 23 bp, Artificial Sequence
  primer
  misc_feature (1)..(23): reverse primer
tgaagaaaagggttgaaacagaa

SEQ ID NO: 324 - DNA, 3271 bp, Diabrotica virgifera
  misc_feature (1)..(3271): WCRW transcript ta00934.001_diavv
gggggtcgcatcaaaacgtcaacaatctgacacgtctgtaatgtttagcctgaattttgagtaaaattaccgaaaaacataattaaaattgatttattaagagtacataataacgtacgaaaatgaccgcggtagaacaaccttgttacacactaataaacttgccaacagattcggagccctacaatgaaatgcaactaaaaatggatttagaaaagggtgaggttaaagtaaaaataagagcattagaaaaaataattcacatgattctggcaggagaaaggttgccgaatggattcctaatgaccatcataagaaacgttttacctctacaagatcatttggcaaaaaaactattattgattttctgggaaatagttccaaaaacaaatccagaaggtaaactactacaagagatgattttggtatgtgatgcctatagaaaagatctgcaacacccaaatgaatttttgagaggttctacacttcgcttcttgtgcaaactgaaggaaccagaattgttggaaccattaatgcccagtattagagcttgtttggatcataggcacagctatgtgaggaggaatgctgtactggcaatttttaccatttacaaaaattttgaagccctcattccagatgctcctgaactgatctccaattatttggatggtgagcaagacatgtcttgtaaaagaaatgcgtttttaatgcttcttcatgctgaccaagaaagggcgttgtcgtatttggcatcatgtttagatcaagtaaattcatttggagatattctacaactggtcatcgttgagttgatatataaggtgtgtcattccaatcctgcggaaagatctagatttattagatgtatatataacttgttgaactcaagcagtcctgctgtcaggtacgaagctgcaggaactttagtcaccctctccagtgccccgactgccgttaaagctgctgctagctgttacattgagttaattatcaaagaaagtgacaacaatgtaaaactcatcgttttggacaggctgatagcacttaaggagcttcctaatcacgaaagaattctgcaggatttagttatggacatactgagagtactctctgctcctgacttagaagtccgcaagaagactttaagtctagcccttgaattagtctcttcacggaacatagaagaaatggtattagtattaacaaaggaagtgagtaaaacggtagacagtgaacatgaggatacaggaaagtacaggcaattgttagtaaggactctacattcgtgttccattaagttcccagatatcgcacgtagtgttataccagtcttgattgaatttttatccgataataatgaactggctgccacagatgtattgctgttcttaagggaagccatacagaagtttaaagaattgcaaccgttaattattgagaaactcatcgaaactttcaaagacattaaattggtcaaagtccatagagcagcaatttggattttgggagaatacgcgagtactgcttccgatatagaagttatcgttggagaaattaacagattgttgggtgaaggatccctcgttgaagctgagcagaagttaatagcaggagatacggaagagaatgctcctgcacctgctgcaggcgccaccactttagttacttccgatggaacatatgctacccaatcagctttcaacactgtcagccaaaccactaaagaagcacgacctcctctaagacaatacctcatggatggtgattttttcatcggagcctctttggcatctacattaaccaaactgtctttgcggtatgaggacctcacctctcctgctgctagcaatggattcaatgccaaaattatgcttattatggctggaattcttcacttgggaaaatcaggacttcccacaaaatcaataaccaacgacgataaagaccacattctgttctgtttacgagtcctatctgatcgttctccaatcattgttgaaattttcaaaaaattgtgccgctcggcactaaatgagatgcttctagctaaggaatcggtagaagcgatctcgcaaaagagcaaagaaaaaaacaagcgtacgattcaaactgacgacgctataagcttcctgcaattagagacagataaaagtggagagctaggagaaaacgtattcgagatgtcgctgtcacaagctttagtaggaggtcgaacgggaggtggcgaatcagtattaagttccaataaattagataaaatcacacaactgactggtttttccgatccagtttattccgaagcatacgttcacgtgaatcagtacgatatcgtgcttgatgtcttaatcgtaaaccaaactaacgatactttacaaaactgcacgctagagctggctactttaggcgatttgaagttggtagagaagccacaacctgtcgtattggcgcccaaagacttttgcaacattaaagctaacgtgaaagtggcctcaactgaaaacggaattatatttggcaacattgtgtatgatgtcataggagcggggtcagataggaatgttgtagttttgaatgatatacacatagatataatggactatatagtgcctgctagttgtacagatagcgagtttatgagaatgtgggcggaatttgaatgggaaaataaggtaaccgttaacacacccctcacggaactttcagaatacctcgaacatctactcaaaagcacaaatttgaaatgtttaacatcagaaaaagctctgagcgggcagtgtggttttatggcagccaatttatatgcaaaatccatttttggagaagacgctttggccaacttaagtatagagaaaccttttaataaacccgatgcgccagtaagcggtcatattagaataagggccaaaagtcagggcatggccttaagtttaggagacaaagtcaatatgacacagaagagcacacaacataaagtagtagctgcataaataaaaacgtttttttctgtttcaacccttttcttcattttaaatcatattctgtaatttaattaatttaatatcatattactggttacacattgttagattataaatatcttttaaagaataaaatttatttagcttttacaaagagcggaaagcaatctttatcttcttctaataagatcaacataaagttttctggaaaatataatatataatttaaaaatgtttagcatttattagtgaaatacatggcttactattttgatgacaaagtcagtgta

SEQ ID NO: 325 - DNA, 606 bp, Diabrotica virgifera
  misc_feature (1)..(606): RNAi target sequence
  misc_feature (577)..(577): n can be any nucleotide
gccctcatcaaacgtaacactaccattcccaccaagcaaacccagaccttcactacttactctgacaaccaacccggagtacttattcaggtatatgaaggtgaacgtgccatgaccaaggacaacaacctcttgggaaaattcgaacttactggcattcctcctgcgccccgtggtgtccctcagattgaagtaaccttcgacattgatgccaacggtatcttgaacgtcacagctattgaaaaatccaccaacaaagaaaacaagatcaccatcaccaatgataaaggtcgtctcagcaaagaagacattgaaagaatggtcaacgatgcagaaaaataccgtaacgaagatgataagcaaaaggctaccatctctgccaagaacgtcctcgaatcatactgtttcaacatcaagagcaccatggaagatgacaaaatcaaggacaagatcagcgaaagtgacaaaactaccgtcatggagaaatgcaacgaggttattgcttggttggatgctaaccaattagccgacaaggaagaatatgaacacaaacaaaaggagctcgaaaacatctgcnaccccatcatcaccaagttgtaccaaggt

SEQ ID NO: 326 - DNA, 22 bp, Artificial Sequence
  primer
  misc_feature (1)..(22): forward primer
gccctcatcaaacgtaacacta

SEQ ID NO: 327 - DNA, 22 bp, Artificial Sequence
  primer
  misc_feature (1)..(22): reverse primer
accttggtacaacttggtgatg

SEQ ID NO: 328 - DNA, 2209 bp, Diabrotica virgifera
  misc_feature (1)..(2209): WCRW transcript 454run12_isotig00560
gatttgattgcagtcattgctgtagtgcacacgtaatttaagtatttatttaagaattgtctgcaaataattaattataagatggctaaagccccagctgtaggtattgatttaggaaccacatactcctgtgtaggagttttccaacatggcaaagttgaaattattgccaatgaccaaggtaacagaaccacaccatcatatgtggccttcacagacacagaacgtctcatcggagatgctgccaagaaccaggtagccatgaaccccaataacacaatttttgatgccaaacgtcttattgggcgtcgctttgatgacagtgctgtacagtctgacatgaaacattggccatttgaagtagtaaatgatgcaggtaaaccaaagattaaagttgcatacaagggcgaagacaaatccttctacccagaagaagtcagttccatggtccttacaaaaatgaaggaaacagcagaagcatacttaggaaagaatgtcaccaacgctgtcatcacagtacctgcatatttcaatgactcacaacgtcaagctaccaaagatgctggaaccattgctggactccaggtattacgtattattaacgaacccactgctgctgccatcgcctatggtttagacaaaaagggccaaggtgaaagaaacgtcctcattttcgatctgggtggtggtacttttgatgtatcaatcttaacaattgaagatggtatctttgaagtcaaatcaactgctggagacactcacttgggaggtgaagacttcgacaacagaatggtcaatcactttgttggagaattcaagaggaaatacaagaaggaccttaccacaaacaaacgtgccctccgtcgtttgagaacaagctgtgaaagagctaagcgtaccctttcctcatcaacccaagccagcattgaaatcgattctctatttgagggtattgacttctacacctcaatcaccagggctagatttgaagaactgaacgctgatttgttcagatctaccatggaacctgtagaaaaggccatcagggatgccaagatggacaaatctcaagttcacgatattgtgttggttggtggatctacccgtattccaaaggtacaaaaactgttgcaagatttcttcaatggtaaagaattgaacaagtcgatcaaccccgatgaagctgttgcttatggtgcagccgtccaagccgccatcttgcacggagataagtctgaggaagtacaggacttgctcttgctcgatgtcactccactttcattgggtattgaaactgccggaggtgttatgactgccctcatcaaacgtaacactaccattcccaccaagcaaacccagaccttcactacttactctgacaaccaacccggagtacttattcaggtatatgaaggtgaacgtgccatgaccaaggacaacaacctcttgggaaaattcgaacttaccggcattcctcctgcgccccgtggtgtccctcagattgaagtaaccttcgacattgatgccaacggtatcttgaacgtcacagctattgaaaaatccaccaacaaagaaaacaagatcaccatcaccaatgataaaggtcgtctcagcaaagaagacattgaaagaatggtcaacgatgcagaaaaataccgtaacgaagatgataagcaaaaggctaccatctctgccaagaacgtcctcgaatcatactgtttcaacatcaagagcaccatggaagatgacaaaatcaaggacaagatcagcgaaagtgacaaaactaccgtcatggagaaatgcaacgaggttattgcttggttggatgctaaccaattagccgacaaggaagaatatgaacacaaacaaaaggagctcgaaaacatctgcaaccccatcatcaccaagttgtaccaaggtgccggtggagctccaggtggcatgcccggtggtttcccaggtggagcagctccaggagctgcaggcgccgctggaggtgctggaccaaccattgaagaagtcgattaaactattcattccattttttaaacttttgttaaccgttgtgcagtattacttgcagacaaagctttttaaaattactttttttacacaatttttcaattgttaaacaacgtttttggtaacagttcaaaaattactgcaataattatgttcgttcatgaataaaataaaaagtcaaatccgc

SEQ ID NO: 329 - DNA, 718 bp, Diabrotica virgifera
  misc_feature (1)..(718): RNAi target sequence
gttgggattgggatttaacaaatacgtcgttctaaatttctaaaactgcatacaaaaaatccttaaaaaactagtgaagattactaaagtgcaatagatacaaaaacaatatttttacgtattcaccataataatataaacgtagaaaatgaatcccgagtatgattatttattcaaacttctgctgattggagattcaggagtaggaaaatcttgtcttctactgagatttgcagatgatacctacacagaaagctatattagtaccattggcgtagattttaaaatcaggacaatcgatttagatggaaagacaattaaattgcaaatttgggatacagcaggtcaggaaaggtttagaacgattacatcaagttattaccgaggagcacatggtattattgtagtgtacgattgcacagaccaagattcattcaataacgttaaacaatggctcgaagaaatcgaccgttatgcgtgtgacaatgtaaacaaattactggtagggaataaaagcgatttgacaactaagaaagttgtcgacttcactacagccaaggagtatgccgaccaattgggtataccatttttggaaacctcagctaagaatgcaaccaatgtagaacaggcctttatgactgtggccgctgaaataaaaaatagagtaggacctccatcttctgcggtagaccaaggaaataaggttaggttcgatcaa

SEQ ID NO: 330 - DNA, 22 bp, Artificial Sequence
  primer
  misc_feature (1)..(22): forward primer
gttgggattgggatttaacaaa

SEQ ID NO: 331 - DNA, 24 bp, Artificial Sequence
  primer
  misc_feature (1)..(24): reverse primer
ttgatcgaacctaaccttatttcc

SEQ ID NO: 332 - DNA, 4464 bp, Diabrotica virgifera
  misc_feature (1)..(4464): WCRW transcript ta00232.001_diavv
gaatcaaggggttgggattgggatttaacaaatacgtcgttctaaatttctaaaactgcatacaaaaaatccttaaaaaactagtgaagattactaaagtgcaatagatacaaaaacaatatttttacgtattcaccataataatataaacgtagaaaatgaatcccgagtatgattatttattcaaacttctgctgattggagattcaggagtaggaaaatcttgtcttctactgagatttgcagatgatacctacacagaaagctatattagtaccattggcgtagattttaaaatcaggacaatcgatttagatggaaagacaattaaattgcaaatttgggatacagcaggtcaggaaaggtttagaacgattacatcaagttattaccgaggagcacatggtattattgtagtgtacgattgcacagaccaagattcattcaataacgttaaacagtggctcgaagaaatcgaccgttatgcgtgtgacaatgtaaacaaattactggtagggaataaaagcgatttgacaactaagaaagttgtcgacttcactacagccaaggagtatgccgaccaattgggtataccatttttggaaacctcagctaagaatgcaaccaatgtagaacaggcctttatgactatggccgctgaaataaaaaatagagtaggacctccatcttctgcggtagaccaaggaaataaggttaggttcgatcaaagtcgcccagtcgaaacaaccaaatccggttgctgctgaaaatatttagttctctttggttgaaggtggtcactcatgtcatctcttttgtacggtagcagcgctacagttactcttattctagtaatatccgtctgtatgtatagttattttaaagtttttgatttgattttcactttagatttttttttcaaaaatatagaaaacaccaatatctcttagcctaatcttaactcccttagataaatatgtaattaacaaaaatatttataaaaccatttttactaaactattagtccacagtatatcgttccttttcaggaatgattgcaaaagtcttaaaaatggttttaattgtttcgtttaaacgagtctaccactttatgaaaaatttcagaaagattatacgttgaaataaaataaattatttttgtcggacaaaaaagaggggcaaacacccgcaagatgtcactctagcgcggtacagttttgttaattacaaaactcataattttcaattgaaagtattgataattactaaatattgtggatctcttgtccgacaaatttgcagcctcgtttctttagtaggacaacggaaatatgttaattatggtaggttatggtttgcggttacaaaagtcataattttaattttttaacgttcaaactgttcaaaaagtaattgtccgacaaaaaaattgttcgacgcaaacttataacaaaaacagtgacagtctacttgtgtttgtcggtataatcgcaaattacctacctctagtatagatgcttagtctagtaattagtctgttccgctctgcggaattgagtaaatggaattaattaaaaataagtgtaaactatgaacaataatatatttatttgtgtcgataaaaagacgtgttttgctcgaaagggtgtgttgttgacgcaccgcatctatcccgacgcccgctggggtgtgactgccgacgggaggttgtaaatcgacccgtggttatgtatcgactgacgctgtggctgaaaaaaaccacaaacgctaatatgtttgtacttctaacatctggccagaaaagcgataaattactacatctgtagttttaagaaacgtcttcgaatgcatttccatgcattgacatggaatctgataaggtaattaattcatggggaattcagtttgttaaactgaacacaccaaaaatatggttagggatacatttcgtttcgtaaaacttcttagcatctggtttgtatattaaatgtgaatttatatgaccgttttgagaaatgatattaaaaaataaaattagcaaaaatagtaattaaagcgtgtcgccacaagtctatgtttacattcggtttctatacattttctgacgttctaaacgtcactggcataacagtctaaacagtgcaacaagtaaagggtccagggctatgttagctcaatttatctagtactgtggcggttgcagtaaaaaaagttttgaaattaatttgtcggactggctatctgatacccaatttttgtcggacattgctctatttggataaagaaccctccaatctatcactttcgtgttcgaaattttataatcgcaatctgcataattgttaattattaacatatttgcgttgttcggctaaagaggggaggctgcaaatttgtctgacaagagatcaacaatctagtaattaattattaataaactaaaagtgggtagttccctgggttggctgtataccatgtagttaaaaaactctaaacatgtagtaaggccacttctgtgtaaaaggtgtatgtactgaaattttaaaaatcccgatggattgaataaactaggttcattcagaacgttttcggacctgtcagtccatcatcagtgaattcatatatacttgcgctaactagtcccagaaccaaacaatggttgtacttataaatcaatctacattatagtgttatgtatttggaaaggctaagcgccgatgttctgatggactgataggtccgaaaacgttctgaattggaacctattttaatcaattcattgggatttttagggttgtagtagatataccttttacacagaagtggttttatttcatgttttttgtccgacgaaaataatttattttattctaacgcgtaattttttgattaaaattaaaaattatagttttgcaatctcaaaacaaccgcgctagagctacaggtttaaaaggaagtcatcaaaaccatttttaagacttttgtaatcatttttgaaaaacgacgatatactgtggactacatatatgagatcattagaacgagaaagatatactcatcgactgttaattttgtattgtttttagtatacctttctctgttttataaatccagatcatgatagattgacgttagaaattattgttcgcttttcaaacgtgtattagcagaattttggcaaattaaatataaaaattcgagatcctttataaaaaggtatatttaaaattccctaagtaagggttatattaagtaacagaacgttttcggattaaaaaatccaccatcagtgttacaaaaaaaaaatagcatgcctgaggcaccgaaatgttacgggtaaaaaccctttaaatgttgacagttgttgtcttatactatgatgttgctaatattcctggatattacccagggcaacacaggactcttcccacgcggttggaatttgagaatttcaatcacgaatttgacacttccaaaatacgtaaagttttccacatctttaatctgcatgttgtgaatagtaaatagagtgtcgttccttgcattggttctcatggacttgattttactaatattaattttcaaatctattttattggcttcagtggaaagtgaattttgaaaaaaaatctgctaaaaatagtttaaaaaatatttttttttagttgtgacactatacagataaaataacgaaaaatttacgaaataatatttatcaaaagtggctcttgcagtacagaatataatatcattattattatctagttaatagactcgtactttttaacgatgtaactttaaaaacaattaacaacgttaaaaaaatactgcaaaaaggaagataaataagtgataaatgtgtcacttttcttgagcactacgcagattgtttggaataaagctatcacgtattatactgtgtaaactccacaaacgacactttatacacatcttagatgaacaaatgcctggcacaagtcgatatgtgacactgtttatgttcggtgcaccgtcagttttggttaatcattagtgtcagctaacgaaaatactttaactataaacttgacactttttgagataagattttgtagttttattaaactgttggtgcaataaaaccgtttttaaaattttttgagttgtgacactatttgagcggaggtgcgacatgtggaaaatatttacaattatttcatatatcacttgttctatacaataaaaaaacgtcatttctaacatgatttttagtgatttctgttggtccaaaacaatttattatattatccatatatacttgttattttttatgtaatgatttttcttattcgctacacattaacgtcattttttgtttatatcaaataaaaagtaatattgtaagtaatatgtgattgtaaatcttggtcaataggttttttgtaaattaaagttattctgaactggaaaaaaaaaaaaaaaaaa

SEQ ID NO: 333 - DNA, 704 bp, Diabrotica virgifera
  misc_feature (1)..(704): RNAi target sequence
ttttgggtgtgaatctgtctatttaatttactcctcctggttaaaaaataaacattagtagattatatctagggtgctcggtaaaaggagtataagtcaaaaatggtcaaaatattatttttgcagaataagactataaaggactatatctttaccttggtatcaatagaacaagtcaatatgctaacataaattaaatcaaattaattggtctttttagtacaactacttaaatgaacttttaatttggtaacaacagtttatgtcaacttatactgtttatacacttcgagtttgtgaactattcttggctctaatagtacatgtcgacatatgtactgttttgaccattgatactgaataatatccaagtaagacggtcgacttatactaagacgatcgctttcagatacgtgtgtcaagcttactaagcaaatattactcttttctgtacgagattttcaagaaacaactgataactattcgcgtttggctgataactaaaccgtgggaattttaccaattaaagattacacttaatagggacagcgagaataagtaatactaacttcttacgtaggtttaatttgataaaaatagatgagtaagtggtttattttctggaccactgtgcaatatgggtgatcgtaacaaacgtgttgcatatattgttagccttatagactccgaaccacctaaaatca

SEQ ID NO: 334 - DNA, 24 bp, Artificial Sequence
  primer
  misc_feature (1)..(24): forward primer
ttttgggtgtgaatctgtctattt

SEQ ID NO: 335 - DNA, 22 bp, Artificial Sequence
  primer
  misc_feature (1)..(22): reverse primer
tgattttaggtggttcggagtc

SEQ ID NO: 336 - DNA, 737 bp, Diabrotica virgifera
  misc_feature (1)..(737): WCRW transcript ta41917.001_diavv
gggattattctagtgacttttttgggtgtgaatctgtctatttaatttactcctcctggttaaaaaataaacattagtagattatatctagggtgctcggtaaaaggagtataagtcaaaaatggtcaaaatattatttttgcagaataagactataaaggactatatctttaccttggtatcaatagaacaagtcaatatgctaacataaattaaatcaaattaattggtctttttagtacaactacttaaatgaacttttaatttggtaacaacagtttatgtcaacttatactgtttatacacttcgagtttgtgaactattcttggctctaatagtacatgtcgacatatgtactgttttgaccattgatactgaataatatccaagtaagacggtcgacttatactaagacgatcgctttcagatacgtgtgtcaagcttactaagcaaatattactcttttctgtacgagattttcaagaaacaactgataactattcgcgtttggctgataactaaaccgtgggaattttaccaattaaagattacacttaatagggacagcgagaataagtaatactaacttcttacgtaggtttaatttgataaaaatagatgagtaagtggtttattttctggaccactgtgcaatatgggtgatcgtaacaaacgtgttgcatatattgttagccttatagactccgaaccacctaaaatcactagaaaaaggacc

SEQ ID NO: 337 - DNA, 221 bp, Diabrotica virgifera
  misc_feature (1)..(221): RNAi target sequence
aatgaaaaacataataacggaagccaaaaaattccgacttaaaataaatgaagaaaagacaaagtatatgataatgggagagatccaaaaagaaaaagagaataacatcatagtacaaatagatggagaaaaaacatactcgttcaaaagagccaaagaaattatttacctgggagccaaaatagatgaaaatggtcatgaagaaggggagataaaggcaa

SEQ ID NO: 338 - DNA, 24 bp, Artificial Sequence
  primer
  misc_feature (1)..(24): forward primer
aatgaaaaacataataacggaagc

SEQ ID NO: 339 - DNA, 20 bp, Artificial Sequence
  primer
  misc_feature (1)..(20): reverse primer
ttgcctttatctccccttct

SEQ ID NO: 340 - DNA, 3813 bp, Diabrotica virgifera
  misc_feature (1)..(3813): WCRW transcript ta03247.005_diavv
cttagcgagatgcgtagagagcagaaagaatatagagatgaaataagagagctacgccaggagaatgtaacattaagagaagaaaacacgaaactaaaacaggcagtttatcaaatagaagaacggcttgaaagtttagaaaatcaaaaaaggcggaaaaatataattatacaaggattgaacatagatacaaatgggccagatatcctaaaacatgcaatgaaaaattttatgcagacagaattaaaagtagatgtacaaatagagaaggctctgaagttaggagaaaaagtttgtctggttgagcttgaaaaggaagaagataaaagaaaaatcatgcgaaacaaaaccaaattgagaaatcgagaagaaggtctagtttatatcaacgatgacctatcaaagaacgacagaattgtacagaaacatgtcagacaaaaagcgcaagaactaagaaaggaagggagaaaagtgaaagtagggtataagaaaatatatgccgatcatgaaatatggcgctgggatggaatgaaccaaacgttggtggtagagaccaaagcaaaaaactaagcaatagcaatgaaaggaaacaaatgacgacgaaaaatgcaaagaataggattacgaactatggaaatagaaacaaatcaagacagcaataaaaaagaaaagccgaaaaatgacaagatacagtttgcaacagggataaataagacggaaacgacgcaggcaatggacaaggcaataagtaaagataacaaaaagaaaactaaagtcaacttgggtacatggaatgtaagaggcacatacgaaacaggaaaactcaaagaattaattagagaaattaaaagatataatgtagaaataatagctttacaagagacaaaacaattggaaacagaaatagtagaaatagaagacgtggtattttttaaaagcgggggagaaaccagaaggttaggaacaggttttataatacagcgaaaatggaaggaaagagtaatggcattccaaccaatatcagatagattatgcacaataagattaaaaggggacaaacgaaacataagtataataaatgtacacgcaccgattgaagatgccacagaagaagaaaaagatgaattctacgagcaattggaaagagaatatgataaattaccagggtttgacatcaaaataataatgggagactgcaacgccaaagtcggaagagagaatatatacgaacacataatagggaaatatagtaagcatgaggtgtcgaacgataatggccaaagaataataggctttgcaacagaaaggcaaatggtgatacgaagcacacaattacgccgaaaagatatatataaaggaacgtggatttcccctgataagaagacagtaaatcagatagaccatattttaatagagaagaagcatgcaaacaatgtaataaatgtaaagagcatgagaggagcggactgtaactctgaccactacctggtgagagcagaatataaaatcgagcataacataaagcgaaacaataaaacaacagaaaaaattggaaaacaatttaacataggactactaaaagataacaacacacagaagaagtatgaacagggaataaccaacagactaatcagggaacaagaaacgtcaagcccagacaaacaatggcaaaatatcaaagaagcaatcttgaacacaagtaaagcaatcctagcgaaaaccaaaagaaaacacaaaacaaaagattggtatgatgaagaatgtcaagaagtagcagaagcaataagaaaggtaagactcaaaaatctcacaaatgacgaagaaagcactagagaagaatacagagaattgagaaaaatcatgaaaagaaaatgtagaagcaaaaagagaaaatacaacgagaacaaactgaaagaaatagaagaaaaatttcaaaaaaaagaaataagatcattctaccaggaagcaaaaaaaatggaaagaggatatcaaaaaaacaacccatatatgagagatgataaagggatgttgctaaatgagcctgaaaaaataatggaaaactggcaaaactatttcacagaactgctaaataagagcgaagtacaaaaggaaacaaaccatgaaattgaagatgatcagatagcaatagaaatacccacagaacaagaaataaagaacgaaataaagagcttgaaaaataacaaaagcccaggaataacagaaatatcggccgaaatgataaaatcaggagggaaaagactacagaaagagatatatgacctgataaaaagaatatgggaagtagaaaaaatgccagaagagtggaccatagcaagaatatgccctatacataaaaaaggtgatagaatgctatgcgaaaactacagaggcatcgcactattagaaatagtttacaaaatcttggcacaaagtataagtaaaaggctaagtcattattcggaaaaaatactgggggaataccaggcaggttttagaaacaacagatcaacgactgaccaaatatttgccttaaaagaaatacagactacctgttacgaacataaaacagtactatatgctttgttcatagactttaagcaggcttacgacacagtaaatagacagcagatgtacgaactgatgaaagaattggggataccaagtaaaattgtcaggatgataaagatgacgatggaaaacacaacaaacgaaatagcttggaaagggtatacatccaaaaagtttgaaaccaaggaaggattacgacaaggagacccactatcaacaatggcattcaatctaacattggaaggaataatcaggaaaagcagaataaacatgcaagaaacgatatttaaaaacggccaccaatgcatagcatttgcagatgatctgacgctattagcaacaagcaaaaaagaactacaaaagttaatgaaaaacataataacagaagccaaaaaattcggacttaaaataaatgaagaaaagacaaagtatatgataatgggagagatccaaaaagaaaaagagaataacatcatagtacaaatagatggagaaaaaacatactcgtttaaaagagccaaagaaattatttacctgggagccaaaatagatgaaaatggtcatgaagaaggggagataaaggcaagaatagctaaaggaaataaaaaatatggagcattacgcacattattgaaatccaaatacgtatcaagaaaaacaaaaataagaatttataagactgttatcagacctacagtaacatacgcatgcgaaacatgggtgctcaaaaagtcagaaacagaccttttagaaagatgggagagaaaaatgcaaagagcaatatatggaggtgtgaaaatagaaggtcagtggagaagaagaaccaataaagaattggaagaactatatcaagagccaacgattacgacgacgatcaaagcacagagaatacgatacttggggcacatcgagagaatgggaagtaaacgaatgccaaaaatggtactctcacgaagaccaatacaaaagaggaggaaaggcaggccaaggaaaagatggaaggacagtgtatatgaagacttgaagaaaagtaacattgagagatggaaagaactagcattggacagaaggagatggagagaggtggtgaaggagtgtataaaaaaactgaagtgtaattaaataaaatttataagttatgtaagttatattaagttataaacaatataacccaaggaataaaaaacctaaacagcttaacaaaaaaaaaacaaacactattgccctgaacaaaaaaagttttat

SEQ ID NO: 341 - DNA, 656 bp, Diabrotica virgifera
  misc_feature (1)..(656): RNAi target sequence
tgcaagtaatcatggcttcagagagatatagcttttctttaactactttcagcccctctggaaagttggttcagattgaatatgcattagccgctgtagcggcgggtgctccatcagtaggaattaaagcatcaaatggtgtggttattgcaacagagaacaagcacaaatcaattctgtatgatgaacacagtgtccataaagtagaaatgatcacaaaacacattggtatggtttattctggtatgggtcctgactatcgccttcttgtgagacaagcacgcaagatggctcagcagtattacctagtataccatgaacccattcctacagtacagttggtgcaaagagtagcgactgtaatgcaagaatacacccaatcaggaggagttagaccatttggagtgtcgctactgatttgtggttgggataacaacagaccttacttgttccaatgcgatccttctggagcttactttgcttggaaagctactgcaatgggaaagaattatgtcaatggaaaaacgttcttagaaaaaaggtacagtgaagagctagaactcgacgatgctgtgcacactgctatccttaccctgaaagaaagttttgaaggccagatgacagctgacaacatagaagttggtatttgcgatgct

SEQ ID NO: 342 - DNA, 22 bp, Artificial Sequence
  primer
  misc_feature (1)..(22): forward primer
tgcaagtaatcatggcttcaga

SEQ ID NO: 343 - DNA, 22 bp, Artificial Sequence
  primer
  misc_feature (1)..(22): reverse primer
agcatcgcaaataccaacttct

SEQ ID NO: 344 - DNA, 857 bp, Diabrotica virgifera
  misc_feature (1)..(857): WCRW transcript ta03948.001_diavv
ggtcaaacatcaaatccacaagtcatcaacacgaagaggaaagttgaaaattgtgtttgtaattgcaagtaatcatggcttcagagagatatagcttttctttaactactttcagcccctctggaaagttggttcagattgaatatgcattagccgctgtagcggcgggtgctccatcagtaggaattaaagcatcaaatggtgtggtcattgcaacagagaacaagcacaaatcaattctatatgatgaacacagtgtccataaagtagaaatgatcacaaaacacattggtatggtttattctggtatgggccctgactatcgccttctcgtgagacaggcacgcaagatggctcagcagtattacctagtataccatgaacccattcctacagtacagttggtgcaaagagtagcgactgtaatgcaagaatacacccaatcaggaggagttagaccatttggagtgtcactactgatttgtggttgggataacaacagaccttacttgttccaatgcgatccttctggagcttactttgcttggaaagctactgcaatgggaaagaattatgtcaatggaaaaacgttcttagaaaaaaggtacagtgaagagctagaactcgacgatgctgtgcacactgctatccttaccctgaaagaaagttttgaaggccagatgacagctgacaacatagaagttggtatttgcgatgctaatggattcagaaggtttgatccatctactgttaaggatttcttagctaatattccttaaatttttttatagtttcgattttttaatattacttggattattaaatttactataagtatcaaaaaaaaaaaaaaaaaa

SEQ ID NO: 345 - DNA, 512 bp, Diabrotica virgifera
  misc_feature (1)..(512): RNAi target sequence
acattcttaaacccggagacaaagtaggagcttccgaagccacattactcaacatgttaaacatttctcccttctcatatggtcttcaagttgagcaagtctatgactcaggcactgtatttgctccagctattttggacatcaaaccagaagatttgagggagaaattcttggctggagtagccaatttggctgctgtttgtttgtccattggacacccaacagttgcttctgctccacacagcattgccaatggattcaagaacttgttggctattgctgctgttactgatgttgacttcaaggaagccaagaccatcaaagaatacatcaaggatcccagcaaatttgctgctgctgctcctgtagctgcagccgccgctgcaccagctgccgagtctaagaaagaagagaagaaggaggaatctgaaagtgaagatgacgatatgggcttgggtctctttgactagaaagttttatatttttgatacgttatttgctgttttgtcgag

SEQ ID NO: 346 - DNA, 22 bp, Artificial Sequence
  primer
  misc_feature (1)..(22): forward primer
acattcttaaacccggagacaa

SEQ ID NO: 347 - DNA, 22 bp, Artificial Sequence
  primer
  misc_feature (1)..(22): reverse primer
ctcgacaaaacagcaaataacg

SEQ ID NO: 348 - DNA, 1042 bp, Diabrotica virgifera
  misc_feature (1)..(1042): WCRW transcript ta20424.001_diavv
  misc_feature (427)..(427): n can be any nucleotide
atacgagtccctaaccacttcaaagatgggtagggaggacaaggctacttggaagtcaaaatacttcaccaaacttatccaattgctagaagactacccaaagtgtttcattgtgggcgctgacaatgtcggctcaaaacaaatgcagcaaattcgtatttcattgcgaggaaatgctgtcgttcttatgggaaaaaataccatgatgcgtaaagctatcaagggccatattgaacacaaccctgctctggaaaagatcttgccccacatcaagggtaatgttggttttgttttcacccgaggtgacttggttgaaatcagagacaaactattggaaaacaaagtcaaagcccctgctagagctggtgccattgctccattatctgtcatcattcctgcccaaaacactggattgttccctgagaanacttctttcttccaggctttgagtagccccaccaagatttccaagggtactattgaaatcatcaatgatgtccacattcttaaacccggagacaaagtaggagcttccgaagccacattactcaacatgttaaacatttctcccttctcatatggtcttcaagttgagcaagtctatgactcaagcactgtatttgctccagctattttggacatcaaaccagaagatttgagggagaaattcttggctggagtagccaatttggctgctggttgtttgtccattggacacccaacagttgcttctgctccacacagcattgccaatggattcaagaacttggtggctattgctgctggtactgatgttgacttcaaggaagccaagaccatcaaagaatacatcaaggatcccagcaaatttgctgctgctgctcctgtagctgcagccgccgctgcaccagctgccgagtctaagaaagaagagaagaaggaggaatctgaaagtgaagatgacgatatgggcttgggtctctttgactagaaagttttatatttttgatacgttatttgctgttttgtcgagtcagactgtcaaataaatgaaacaggtcgc

SEQ ID NO: 349 - DNA, 700 bp, Diabrotica virgifera
  misc_feature (1)..(700): RNAi target sequence
  misc_feature (471)..(471): n can be any nucleotide
ggggagtacaatgtcggctaccagactggagaacggtgcgggtgattatattcaaacagaattgatatcgggcatcgatttcgttaataaaaacaattctaaaggacattgcgccaatggagaaactgggttaaatgaacacactaaatacaagaatggatttaaaaagtcggtcatttccaatggacatgtcacatcatcagacgaagaaacgacaaaaaataggacaaaaaatggttacaaaacagacacatcaacagacgaaccaaaaatccgacaaatcaaagaatccttcgaaccgcctacgttgatcaccaaagcactcacccacatcagtttctacatcctcatgttcttaggatacctcagccaggcgctgtttccacctaagttggtcaaagaaaaaaaatcgggaaggctatcgaccgttgtctgatcgttttgccgctttctattcccagtacgtctacnggcgtatcaaggattgttggaacttacccatttgcagcgtaccaggggatgaagtcgtacttaaagataggattacgagagatcattgctggacctttgaatttacggggtccaaaacgaaatgcataaatttggcttcctacaactacttggggttcgcagaagccacaggtccctgcgcagaacatgcgattcggacgatttacacggatggcattagtaccggaag

SEQ ID NO: 350 - DNA, 18 bp, Artificial Sequence
  primer
  misc_feature (1)..(18): forward primer
gagtacaatgtcggctac

SEQ ID NO: 351 - DNA, 21 bp, Artificial Sequence
  primer
  misc_feature (1)..(21): reverse primer
cttccggtactaatgccatcc

SEQ ID NO: 352 - DNA, 2113 bp, Diabrotica virgifera
  misc_feature (1)..(2113): WCRW transcript ta00669.001_diavv
ggggacagacaccagccgcagacctccaggcatgcgcttattcagcaaggtggtgtgactgctgtgagatggctgtgtcggctgtacgaaattacaggttagattaggtttgggttgggagttttctttgatttgttcgtgtgttgtgcctaaaaacttcagtacaatgtcggctaccagactggagaacggtgcgggtgattatattcaaacagaattgatatcgggcatcgatttcgttaataaaaacaattctaaaggacattgcgccaatggagaaactgggttaaatgaacacactaaatacaagaatggatttaaaaagtcggtcatttccaatggacatgtcacatcatcagacgaagaaacgacaaaaaataggacaaaaaatggttacaaaacagacacatcaacagacgaaccaaaaatccgacaaatcaaagaatccttcgaaccgcctacgttgatcaccaaagcactcacccacatcagtttctacatcctcatgttcttaggatacctcagccaggcgctgtttccacctaagttggtcaaagaaaaaaatcgggaaggctatcgaccgttgtctgatcgttttgccgctttctattcccagtacgtctacaggcgtatcaaggattgttggaacttacccatttgcagcgtaccaggggatgaagtcgtacttaaagataggattacgagagatcattgctggacctttgaatttacggggtccaaaacgaaatgcataaatttggcttcctacaactacttggggttcgcagaagccacaggtccctgcgcagaacatgcgattcggacgatttacacggatggcattagtaccggaagtaccagacaacagtacggaacgtgtgcactccatgacgaactggagcagctgatagccgaattcgtaggtgccgaagattccatcacctttggaatgggtttcgcgacgaactcactcaacattccaacactcgcatcgcctggttgtctgatattgagtgacgaaaagaatcatgccagcttgatattgggtatcaaacttaatcatcccaccgttagagtatttaaacacaataatgttaagcatctagaaaaactcctccaagaagccatctactacggccaacccggccaacccaacaacgagtacaaaccttggaagaaaatcattatttttatcgaaggcgtgtatagtatggaaggaaccataggccgccttccggaaattatagctcttaagaaaaagtacaaagcttatttatatttggacgaggcccacagcataggggccatgggcaagcacggcaaaggtgttgtagattatttcaactgtgatcccaaagatatcgacattttgatgggtacgtttacgaagagttttggaggcgcgggaggatacattgcaggttcaaaggaattcatatctttcattcgcgaacatagtcacgcgtctggtcacgcttgggcgatgtcgccgccagtcgcagcacagatcatatcagttctaaagataatcatgggcaaagatggtacaaacgaaggacaaaagagaatcgaaaggttagctaggaattccagatacgtcaggttgcgtctcgaacagatgggtttgatcgtacacggtaaccaagattctccagtagttcccattttagtttatcgttactcaaacgtagcggtagtggtaagaactttaattaaagaaaaaatagcaacagtaggcgtaggatatcctgcaacgccgcttgcggaatgcagaataagaatctgcatatcggcgggccacacgaaagagcagctggattatgccttatcagttatagaaaaagtagcagatgaaataggtattaagtattctagaaaaccgagagatccaaaaccgattgattacaataaaatcaaaatatatcaggatttgttttagagagagacttttagatgaagcttcaagagaacaccagcctgcgataggaggttttgttgtttttataaattttataaatgcatttaatatttgatttcaaaagctatttattaagaatcgtttttggctctgttttattttaatactttgcaaaataaaatataaaaacagaaa

SEQ ID NO: 353 - DNA, 440 bp, Diabrotica virgifera
  misc_feature (1)..(440): RNAi target sequence
gggtaatgaaagattccgttgtccagaagccctcttccaaccatcctttttgggaatggaagccaatggtatacatgagactacctacaattccatcatgaagtgtgatgttgatatccgtaaagacttatatgccaatactgtactctctggaggtaccaccatgtaccctggtattgctgacagaatgcagaaagaaataacctccttggcacccagcacaatgaaaatcaaaattattgctccaccagaaaggaaatactctgtttggattggtggttcaattttagcctctctttctactttccaacagatgtggatttccaaacaggaatatgatgaatctggaccatccattgttcacaggaagtgcttttaatttttatctatgtttaagtatattctttatatatcttgttttttatatcccccatcttggg

SEQ ID NO: 354 - DNA, 20 bp, Artificial Sequence
  primer
  misc_feature (1)..(20): forward primer
gtaatgaaagattccgttgt

SEQ ID NO: 355 - DNA, 21 bp, Artificial Sequence
  primer
  misc_feature (1)..(21): reverse primer
cccaagatgggggatataaaa

SEQ ID NO: 356 - DNA, 1465 bp, Diabrotica virgifera
  misc_feature (1)..(1465): WCRW transcript ta15851.001_diavv
ggagggcattccagtcttgtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtactactggtatcgtattggattctggtgatggtgtatcccacactgtcccaatctatgaaggttatgcacttccccatgcaatccttcgtttggacttggctggcagagatttaactgattacctcatgaaaatcttgactgaacgtggctactctttcaccaccacagcagaaagagaaattgttagggatattaaagaaaaactctgctatgtagctttggacttcgaacaagaaatggcaacggctgctagttccagttcccttgaaaagagttacgaacttcctgatggacaagtcatcaccattggtaatgaaagattccgttgtccagaagccctcttccaaccatcctttttgggaatggaagccaatggtatacatgagactacctacaattccatcatgaagtgtgatgttgatatccgtaaagacttatatgccaatactgtactctctggaggtaccaccatgtaccctggtattgctgacagaatgcagaaagaaataacctccttggcacccagcacaatgaaaatcaaaattattgctccaccagaaaggaaatactctgtttggattggtggttcaattttagcttctctttctactttccaacagatgtggatttccaaacaggaatatgatgaatctggaccatccattgttcacaggaagtgcttttaatttttatctatgtttaagtatattctttatatatcttgttttttatatcccccatcttggggcaagaactgcctatgttatatgagtgatcttgtgatttattacacgttcagcataagacttaatgagctttaattttaagaagtgtaagttgaatactctgtttcatatttattttacctttgtaatataataaacaaaaaaaaaaaaaaaaaa

SEQ ID NO: 357 - DNA, 600 bp, Diabrotica virgifera
  misc_feature (1)..(600): RNAi target sequence
gttcgctagttccgtagtgtgttgtgcacatttaacatcgttctggcctgtagatactcctaataacttaaaaaatggcagatgacaaacaccccgtctatggacccttctttggagtcatgggagccgcggctgctatcattttcagttcgctgggcgccgcctatggtacggcaaaatcaggaaccggtattgccgctatgtcggtcatgaggccggaacttatcatgaaatgtattatcccagttgtcatggcgggtatcattgccatctacggtctggtcatagctgtactgatctctggtaacatccaagacagctctacatattcattgtacagtggttttgtccatttgggtgctggtctttcagtaggattttcaggattggcggcaggtttcgctattggtatcgtaggtgacgctggtgtaagaggtaccgcacaacagccaagactcttcgtaggaatgatcttgatcctcattttcgccgaagtattaggtctttatggtctcatcgtcgccatttacctctatactagagcttaagcgcccagctcccctaaattttcatctcctaaacacagcgtaccaaaagttg

SEQ ID NO: 358 - DNA, 23 bp, Artificial Sequence
  primer
  misc_feature (1)..(23): forward primer
gttcgctagttccgtagtgtgtt

SEQ ID NO: 359 - DNA, 22 bp, Artificial Sequence
  primer
  misc_feature (1)..(22): reverse primer
caacttttggtacgctgtgttt

SEQ ID NO: 360 - DNA, 2938 bp, Diabrotica virgifera
  misc_feature (1)..(2938): WCRW transcript ta15854.001_diavv
ggacctgaaattggcggatcgtcatatgggggattcttgcggggggcagtcgtgtaagccatgggggtcagtgggttcgctagttccgtagtgtgttgtgcacatttaacatcgttctggcctgtaaatactcctaataacttaaaaaatggcagatgacaaacaccccgtctatggacccttctttggagtcatgggagccgcggctgctatcattttcagttcgctgggcgccgcctatggtacggcaaaatcaggaaccggtattgccgctatgtcggtcatgaggccggaacttatcatgaaatgtattatcccagttgtcatggcgggtatcattgccatctacggtctggtcatagctgtactgatctctggtaacatccaagacagctctacatattcattgtacagtggttttgtccatttgggtgctggtctttcagtaggattttcaggattggcggcaggtttcgctattggtatcgtaggtgacgctggtgtaagaggtaccgcacaacagccaagactcttcgtaggaatgatcttgatcctcattttcgccgaagtattaggtctttatggtctcatcgtcgccatttacctctatactagagcttaagcgcccagctcccctaaattttcatctcctaaacacagcgtaccaaaagttgcgcatctcgccccgatcattttgtttttaatgtctacatgtaaaaataaaaactgtataaatggtagcaggcgatgaaagtgactgaggcgggcaatgtaaataatttagttatgatggggcccgtatttttcgcgtacggggcaaaacaaattaataattttagtaaaaaagactgggcctcttcatcgctgctgtgtccacacacacgactaataattccttatttccatattcatggaaccggtcgagttttcttgacaggtttttgtattaaaacgaattttcttcctaggcaaaataaaggtcttagttactaataggttgttcaaatgaaaatgtacgaaacgacactgtgggtataaatgaagtctttattcaaagtattcaccatttacctgagcacaacgatgccgttgattagccgaaggattcattgatcccagaactcctgtgaccatgaacagtcttccccgtatacatccggcgttgaatagcaactggtttaactaacaccttccgccgtcagaaacctgataacgcctcacgaattttgcaacatgaaccccatgatgtgcccacacgaactgtcgcgtcaattgaacggctctcttataagagcctctattctctcctgcgcatgcgggcgcccgggaatgccccgatcgaatccgaaggctacatttgcctccctggatgtctcactacgttatcccataacggcataggcaattatgtttgcggttaagttgttacgacgtttcgtgccttttcatttgatcagtcgcagtataatatacaagagaagagggaaaacaaattttgatttattttgcctcgtacgttacaatacctgtgctatcattgtaaataattttaaacatacttagaagcctctatttcattttcatggcgggtcaccactattattaaattaattgtatagttagtagaatttaggttaccgtttttcttttaatataaaagctagactctattgagcctaggaagtatttgaataaagttaaaaaagtagcacaatttatttttaatttcacaaaaatactgtacatttgttttatcattagtgtgttatacttgatatatcattttcatggccttacgaaggcttggtctctttatacaacaaatggttcgggaatgttatttttgacaatttttttgaatagcaagttttaagccagtaaaactgtggtattttttttcaatgcatcatcttttttaataaaaaaaactttggttaatggggcattacatcgcaaaaccgtaatttctaaataatatcgtcttaatttatttatctaacaatgtactgtctaaataacattcgtaaaccctgtacatttttttaatagtcaatttttatttgttcccatcctcatcagttttgcttacctttttttctctctcaaaaatatgatttcaaaataatctatgttccattaccttccaaaaataatataaaacggttttattatatcagcattgttgtaaatatgacaacttatgtgtatcgatggtttttttgatgtccatagctgtacgtgttagcctaaagtgtagtcatagctttggcaaaaaacatccccgttttcaacactgacgaaacttctatttaatagacagacggtgatgctttttgactttagcagataagaatgttatacagggttaacaaaaatgagaatactacgtctgatatatcctgtaacacacaaaatactttaaagctcagttacacgatgctaataacttgttttactggaatataaaacaccaatttacacaaggagagtactaaaagtcagtacatactcggttttagtgactcacaagtgttactagcatggtgtaactgagcctttatcctggcattccaattactggacaatgctatcatataaataccatgccatctaaataggtaatctacttgttagtcctaagagtttatcactatttaagtaaacgatgaattgaattggctgttttgtgttacaaggctagtaagttttctcttttcaagtcaaccctgtagtatctcctttttattttagtcatgaatcatcatctcagcacgaagcttgttgggcaagtgtctgccggttttcggtggattcggtccatcgaaataggcagacattgtgtcctattgttgtagagtattatattataatgtagattggttctgttgtaagaagggaacagcaaaattatgttgaaaataaataatttgtacattcc

SEQ ID NO: 361 - DNA, 525 bp, Diabrotica virgifera
  misc_feature (1)..(525): RNAi target sequence
gggatctccatcttcctttttcatttagtgtaaagcatgcctttccaaaggtttgtagaaaccggccgcgtggccgttgtatcggaaggcccacataagggcaaacttgttagtattgtagacgtaatcgaccagacaagggttttagttgatggccccaatagcaatgtacccagaggacagcttaggttaaatgaattgcatttaacaaagttccgcattaggtatccattttcagctccaactcgtgttgtaagaaaagcatggactgatgctaagattgatgaaaaatggaatgaatccgtctgggccaaaaaagtagcagccaaggaaaagagatcacaacttacagatcttgaccggttcaaacttcgtagggctcgttcacgaagaaaccacatccgtacagctactttcctttctttaaggaaggccgcatcaagaaacggtttcctctatggtaaaaagaagatggctaaaggaggtgacaaacctaaaccaagcaagaaggcgaagaaagaaaag

SEQ ID NO: 362 - DNA, 22 bp, Artificial Sequence
  primer
  misc_feature (1)..(22): forward primer
gggatctccatcttcctttttc

SEQ ID NO: 363 - DNA, 22 bp, Artificial Sequence
  primer
  misc_feature (1)..(22): reverse primer
cttttctttcttcgccttcttg

SEQ ID NO: 364 - DNA, 689 bp, Diabrotica virgifera
  misc_feature (1)..(689): WCRW transcript ta01695.001_diavv
aagaatacgaagagctactaacattacttaaataaactatagtttaagattttaatctgtcaacaactgtgatagccaggttcctttttcatttagtgtaaagcatgcctttccaaaggtttgtagaaaccggccgcgtggccgttgtatcggaaggcccacataagggcaaacttgttagtattgtagacgtaatcgaccaaacaagggttttggttgatggccccaacagcaatgtacccagaggacagcttaggttaaacgaattgcatttaacaaagttccgcattaggtatccattttcagctccaactcgtgttgtaagaaaagcatggactgatgctaagattgatgaaaaatggaatgaatctgtctgggccaaaaaagtagcagccaaggaaaagagatcacaactcacagatcttgaccggttcaaacttcgtagggctcgttcacgaagaaaccacatccgtacagcaactttccttgctttaaggaaggccgcatcaagaaacggtttcctctatggtaaaaagaagatggctaaaggaggtgacaaacctaaaccaagcaagaaggcgaagaaagaaaagcctgcatccaagaagaaataatttttagattaaatgacaatatatttgtttaaaaaacaaaaaaaaaaaaaaaaaatagaaaccatcattaactat

SEQ ID NO: 365 - DNA, 551 bp, Diabrotica virgifera
  misc_feature (1)..(551): RNAi target sequence
ggggatctttagtcagtgctttagaggccacgaagcaatttctaggatagacgaacgacgctcgcgacgacgcgctgcgacgcacacgacaaaaaaatacacaatacgacaccacgcgccattttgccattttctgtgtgtgcagtgaagtgaagtgctactaaaatcttcaaaattcaacccttctaagaaggccgatttcatgtgttctatatcgaagtaaaagagcaatagcatgggagtggcagaggatttcgctcccagcttcacgcaaaagcctcaattgaggcaggaggacgatggaaacaaactcattttcgaatgccagttactggctgctccgaaaccggaaatcgaatggtttcgaagcgatataccactttcagaagacagtagaactaattttaaaattcaatccataggcaccaacaaatttttagtagtactcgaattagatgatgttattgaaaccgacgctggcctttacaaggtcaaagcgaaaaataccatgggggaaatagcagcctccatcaatctcaactacagcccca

SEQ ID NO: 366 - DNA, 19 bp, Artificial Sequence
  primer
  misc_feature (1)..(19): forward primer
gatctttagtcagtgcttt

SEQ ID NO: 367 - DNA, 21 bp, Artificial Sequence
  primer
  misc_feature (1)..(21): reverse primer
tggggctgtagttgagattga

SEQ ID NO: 368 - DNA, 6974 bp, Diabrotica virgifera
  misc_feature (1)..(6974): WCRW transcript ta35139.001_diavv
acaatacgacaccacgcgccattttgccattttctgtgtgtgcagtgaagtgaagtgctactaaaatcttcaaaattcaacccttctaagaaggccgatttcatgtgttctatatcgaagtaaaagagcaatagcatgggagtggcagaggatttcgctcccagcttcacgcaaaagcctcaattgaggcaggaggacgatggaaacaaactcattttcgaatgccagttactggctgctccgaaaccggaaatcgaatggtttcgaagcgatataccactttcagaagacagtagaactaattttaaaattcaatccataggcaccaacaaatttttagtagtactcgaattagatgatgttattgaaaccgacgctggcctttacaaggtcaaagcgaaaaataccatgggggaaatagcagcctccatcaatctcaacttcagccccatggacgaaccaaaagaaaaacaaatagacggcctagcacccacttttgcgaagaaaccagctattcgccaagaagatgatggcaaaaaattattattcgaatgtaggatacaggccgatccccgtccaaccgtcagttggtcccacaatggcaacgctgttagcgaaggtccacgtcacaagttgaggatagataaagatggccattcatattttgcgacccttgaaataatcgatgtcacggtagaggatgctggcaaatacaaggtgaccgcaaaaaatgacttgggagaaagtaacgccacaatcagccttaactttgacagtggagatagcgctgatggctttgcgccttctttccttgagaaacccaaaatcatacctaatgagagtggcactcttattactatgaaatgtaaatgcaaagctaaacctaaacctgacgtcacgtggttccgcggaaccacagccgtcaaggaatcttccaaaattaaaatccagatcgttgatctcgaagaagacaaattcgaactgtccttagaaatcaaggatccatcggcagctgatgggggtacttacagatgccatgtgaagaacgaatacggagaaagtaatgcaaatctgaacctaaatatcgaagcagaaccagaaccagaaggagaaggaccaacgttcgtcgaaaaacccaggataacctctcacgatggaggcaaactcgttgtcatggagtgtaaagttcgtgctaatcctaaacctactatagtttggtacagagaaagcaaagaagtcacagaatcatccaaaattaagatcagtattaaacaaacagaagaagatatatattacgtcaaattggaactcaatgatccggggattgatgactctggcttgtacaaatgcaatataaggaacacacttggtgaactcaacgccaacctcaccttaaacatcgagattattcctgttatcaaagaaaaacccaaagttattaaaatcattaagaagaaaactgttattgttgaatgtaaagttctcagcaagtttgcacctgattgtacatggtttaaggaaagcgatgccgttaaagaagattcaagacatactgttcacgttgaccaagttaaagacggcgaatttactgttaaactcgaaattaatgaagttgagaaaaaagacaaaggtatgtacaaattggttgctaaaaacgaaaagggtgaggcaacttcacaagtcgttgaagtcactgagttacctccagaggagaaacccaaaggagacaagccgaaactgaccaaactaaccaatatcgttactgacgaaggaaaatcagttgattttataacttctctcaaaatcgaagacaaaacagtcaaaatcacatggtacaagaacaccactgtgataaccgaatcttcagaaatcaaaatctcttttgatggcactgtgacgcgacttagcattagtaaatgtaaagtatcacattccgctacatacaagtgcgttgccaaaaacgaatttggcgaagacgaaataagcgctacacttaaagtaaacgaagctaaagaggaagatgaagaagaagaagaatccgaagaggaggttatcgaagaaaagaaagaggaaaagaaagaagaaaagaaagaagaaaaacaggaaaagaaagttgaagagaaaaaagaagaaaaaaggtagaaaagaaagaagagaaggttgaaaagaaagtagaaaagaaagaggaaaagaaaacagaagaaaagaaagcagttaaaaagatagaaaagaaagaggaaagaaaagaagaggagaaaatgataattaagaaggacgaagaaaagaaaaaagacgaaaagattgtggccaaaaaggaagaggaaaagaaagatgttgagaagaaaataaggcgtacatcggttcaacagaacgaagaagtaagaaccgaatcacgcagaagctcaattatacaaaccgaagaaaaagttattaaagatggaaaagttagtaggaaatcttccatttcaaaagtcaatgaggagagtaagactgagtccaggcgcacatcattagtagatgacaagaaaaagataaccaaagataccaaaaaattggaaaccacaaaagaagtgtcagaagaaaagctgggagtagccgaagttaaaaagctggaaaaacctaaaagggtaataccccctaaagaagaagctcaaaagggttcgttcttgaacattcaattgaaaccagttcaatcggagggtaaaaaagctgaaaaggcgaataaacttgaagttgacttgaagaaaggagcagttgaagagaaaaagacaacagtcaaaaaatcttctgccaaaaaagaagattatgatattaatgcttgggaaaatatccctgattacgacagaccagtgttagagaaattcgaaaaacatgatgctccagaatatgctggtagagaaaagagtaaattctctaaggaaagaccatctatctcagtcgaaggaaaagaaaaagctccttctcagtcagctatatctgaacaacctagacctagccttcctcaaattaagactccagatgcacccaaaatcgaagtgagtagggaaaaaactcccgaacccagaaagaaatctctcgagcctggctcaggtccaggaagtcgtagaggatctcttattcctccagaagccatgggcagacgtgccagtcttatcatctccgatgagggaggaaaattacgtcctggggaagtgctagatccaaagcgtcgtcgtccgagctccgacgtacgtcgaccaagtttagctgaattggaggatctcgtgaacaaaccctcgactcctttgaaaccttccggtccaaagggagcagcacctcaaattgtcgatgtccaagaaaattactcctcagttgaagatcaaactgcttacattactatccaagttgagggtgatccaccaccgacattcaaattctataagggtatgactcaacttattgagggtggtagattcagatttgtaaccgatggtgaaacaaacttgatcacactctgcattagaaaggtaaagcccaatgatgagggtacctataaagttgtcatagccaacgtccatggtgaagactccgctgaaatgaccctcttcgtagctggtgctggaggtgttgatttccgttctatgctcatgaagagaaagtacgccaaatgggataaggataaggaagaccccaactggggagacttaaaagaggttgaaaaaccagtgccagcattaaaaaaagtcgaaaagaaacaagaaagtttccttaaaccattggtagatcagttcgctaaagaaggaaaagataagaaagttgtgttcgacgctggtttctcaaaaaccaactgtaaaccaaaatggctgttcaggaaagacgaacttttcccaggatctaaatacaaatttaagaatgaaggtgacgtgtaccagctgatcatcagcaatcctaaagtagaggatactggaaaatacacaattgaaatcggaggagtcagctctaccggtttcctgacagtagatgaaccagatccatgttacacctttaccaaagcactgaagaaaaaatatgatggatacaccaaacatgaagttgaactggcttgtactgtaagcagtagtttggccattgttggttggtataaaggagagacaaagttggaagataatgataaatttagtatctctaaagatattaacggagtctgtagactgactattaaagatgcgacatttgatgatgctggtgattacacctgcaaactagaaaaacaaaccgaaaagacacaaactaaagttaatattgtagactacccatataaattcgtgaaagtacttaagcatcaacaacttatagaaaaagaaaatgttacattagtatgtgagctcaacgatgctggtggtgatgtacagtggtttaagaacggagaagaaatcaaaccagataaacgagtagttatcagtaaagatggtcgcaaacgcaaactggtaattaaagacgccaaagttactgatgctggtatgtactcttgtactaccaatgcagacaaaaccgaagctgagcttattgtgaactacttgaaccgctttaacaaaaaactgaaagacactgttgctgttgaacgagaaaaactagttttggacattgaactacaagatcaaacagccccgtgcgagtggttgttcaatggcgaaccaatcaagccctctgagagagtcgagatcaaaaacttgggaggtggcaagcaccaactcatatttaatggtttagatatggcagatgacggtgaaattaagtgtgtatcaggaaaacttgaatcttccatgatgctttccgtcaaaaaaggtgaaagcaagcctgaaattgacttcccatcagacttcgctgcaccaattagcaaacctattgtccttgaagtaccatacaaaattagtggaaccagacagacacctttggaagctaaacttatcaaagacggaaaggtactacctctaaaagacgtagagacaataatttcagacgacaaagtcatattcaaaattaaaaaaccatccagagaccaatctggtccataccagatcaaattatcgaacgggcaaggtgaggatgttaaagatgtcaagatcaccatgcaggacgttcctgctccaccagaagacgttaatgtaacagatatattccaagacaactgtaaaatatcctggaaaccacccaaagataatggtggagcacctcttctccattatgttgttgaacgacaagatctcagtctcaaagctggttgggaaaatgttggtgaagtaaaagccaatgaaccaactacattcaaagttgaaaaactaattcccaagaaagaatataaattcagaatcagagctgttaaccagctaggtcctagcgaacctgctctattcggtaaaccagtattagctaaagatccttgggatgaagccagcaagcctaaagatgtagaagtagttgactgggatgttgaccacgcagacattacttggaagacacctgacagcgatggtggagctcctattactggctacgttattgaattttaaagaaaaattcgccaaagattggaaaaccggtgttgaagtaccaggtgaccaactgaaaggaactgttcctaaactcaaggaaaacagtcagtacgaatttagagtaagggctattaataaggctggaccaggagaacctagtgatcccaccaaacctatcatagctaagtgtagattcgtaaaaccatttattattggtaatgacttaaacagtattattatcaagaagggacaagttgtaaagtacgatattaagtacgggggtgaaccagaacccgaggtgcaatggttcctcgataaaaaagaaatcaaacccgacttggaagaaagagttactatcgacaaatatgacagaaacactattattacagtacgcagatgtacaagagctgacagtggaaaatatcgtttggtacttaccaacagctctggtacttgtgaaggggtggcggaagttattgttttagataaacctacaccacccaaagctatgaaagtcgaggaaatccgtgcagatcacgttaaagttgcatggcaaaaaccagaagatatgggtggtactgacctaactggttatatattagaaaaaatggatatggacacaggaagatggattcctgcaggtgaagttggtcctgatgaatcaaactttacgtttaagaacctgacacctaagaagaaatacaaatttagagttcgagctaaaaataaagaaggagaatctgaacctttggaaaccgatgactttattctagccaagaatccttacgatgagcccggagcacctggacaaccagaaatctttgactatgacaacaagagtgccagccttaaatgggctaaaccagatagcgatggtgggcgccctatcacccattacacagtcgaaatgaaagataagtttgcagctgattggactgaggtagccaagacgcctgacgctactcctgaagtggtcgtacctggtttaaaagaaaatatggtatatcaattccgtgtgaaagcacacaataaatcaggacctagtgtaccttccgcaccaacagctaaccacctctgcaaacacaaaaacttaaaaccaagaattgatcgtgaaacatttagagctgtcactataaaagctggccgtactcataagtgggcagttgactttatgggagagcctccaccatctgtcaaatgggtatggagagatgacattccattatcaaatagtgaacgtatcaagatagaaaactccgactaccatacggacttcacactcctcaacgctgttcgtaaagactcaggaaaatacacgcttactattgaaaacgttaacggaaaggatactgaaacagttgaactgactgtattgggcaaaccagcagcccctgaaggacctttagttgtatctgatgtgactgcagaaaaagctaaagttag

SEQ ID NO: 369 - DNA, 586 bp, Diabrotica virgifera
  misc_feature (1)..(586): RNAi target sequence
gggggagtagtcggtatgtatttgaatttatcttaatttgtttaatattagtagttaaatattaaactatagttagaagttgttatatatttgaccattagttgactccccaaaatgcagatcttcgttaaaaccttaacgggtaagaccatcacccttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcagaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattactgtggcaagtgcggttacactcttgtcttctccaaaccaggagatgagaaat

SEQ ID NO: 370 - DNA, 19 bp, Artificial Sequence
  primer
  misc_feature (1)..(19): forward primer
gagtagtcggtatgtattt

SEQ ID NO: 371 - DNA, 22 bp, Artificial Sequence
  primer
  misc_feature (1)..(22): reverse primer
atttctcatctcctggtttgga

SEQ ID NO: 372 - DNA, 683 bp, Diabrotica virgifera
  misc_feature (1)..(683): WCRW transcript ta06472.004_diavv
ggagtagtcggtatgtatttgaatttatcttaatttgtttaatattagtagttaaataggaaactatagttagaagttgttatatatttgactattagttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattactgtggcaagtgcggttacactcttgtcttctccaaaccaggagatgagaaatagatatatgtccttgtatattgtttaagaaaaaaatagaaaaacctttgtttatttgaataaaatattcgaggaaatatatctatttctcatctcctggt

SEQ ID NO: 373 - DNA, 611 bp, Diabrotica virgifera
  misc_feature (1)..(611): RNAi target sequence
ctccgaagacagacagtcgattttattcagtgattctgattgttcagtttttgtagttgtacagttttcgtattaggaaataaatcaaatatggcatcaggagtaactgtagcagatgcctgcaaaaaggtccatgaagaaatcaaaagggacaaaaaacacagatttgcaattttctacatcaaggatggcaaacagattgatgttgaacacataggagaaagaaatgcagagtatgatgatttcctaactaaactgcaagagggaggagctaatgaatgtcgttatggacttttcgattttgaatacatgcaccagtgccagggaacctcagagtcaaccaagaaacaaaagttattcctgatgtcgtggtgtcctgaaactgcatctgtcaaaaagaagatggtgtatgctagctcattcgaatatcttaaaaaagctttggtaatacagaaatctatccaagcgacagatttagcggaagcgagtataacagcggtagaagaaaaattacgatccactgatcgtcagtaacgccttttatttttattatttttctttttgtatctcgactgtctactcgcgcgccgacctgccgaggtgtattattt

SEQ ID NO: 374 - DNA, 21 bp, Artificial Sequence
  primer
  misc_feature (1)..(21): forward primer
ctccgaagacagacagtcgat

SEQ ID NO: 375 - DNA, 22 bp, Artificial Sequence
  primer
  misc_feature (1)..(22): reverse primer
aaataatacacctcggcaggtc

SEQ ID NO: 376 - DNA, 1099 bp, Diabrotica virgifera
  misc_feature (1)..(1099): WCRW transcript ta00957.001_diavv
gggaaatcgcgagaatacgggcgaggtttgaagtttttaattttttgttcatatcaccacttaaagctattgttatcattttagcatatataaaacaatagcttctgtgttggggattaacagtcgcggttgagctaaaaaatatatatttgttaatgttataaataatattcaaaaagtttgtttaattcaaaactggcgcatttcgtacgcatgaaaaaatagttcgaattgacattggaaacattttgatagttgtggtgacgtttgctgtaaatctatttaatttttggtgatttaataattgaaaatatttctgggaattaacgtagtttctagaaaaaatatcggtgacttattttggcgtagtaaaattgactcgcgcaggcgtacccccagctgccggtaggacaacgtccccaacagatctccgaagacagacagtcgattttattcagtgattctgattgttcagtttttgtagttgtacagttttcgtattaggaaataaatcaaatatggcatcaggagtaactgtagcagatgcctgcaaaaaggtccatgaagaaatcaaaagggacaaaaaacacagatttgcaattttctacatcaaggatggcaaacagattgatgttgaacacataggagaaagaaatgcagagtatgatgatttcctaactaaactgcaagagggaggtgctaatgaatgtcgttatggacttttcgattttgaatacatgcaccagtgccagggaacctcagagtcaaccaagaaacaaaagttattcctgatgtcgtggtgtcctgaaactgcatctgtcaaaaagaagatggtgtatgctagctcattcgaatatcttaaaaaagctttggtaatacagaaatctatccaagcgacagatttagcggaagcgagtataacagcggtagaagaaaaattacgatccactgatcgtcagtaacgccttttatttttattatttttctttttgtatctcgactgtctactcacgcaccgacctaccgaggtgtattatttatataagtatttgaatatttaataaagcttcatttataaaaaaaaaaaaaaaaaaaaaaa

SEQ ID NO: 377 - DNA, 357 bp, Diabrotica virgifera
  misc_feature (1)..(357): RNAi target sequence
aaaatgtccaagagaggacgtggtggttccgcgggagcgaagtttaggatctcccttgctcttcctgtaggagcagtaattaattgtgcagataatacaggagcaaagaacttatatgttatcgctgtacaaggtattggtggacgacttaaccgtctgccagctgcaggatctggtgacatgattgtagccacagtcaaaaagggtaaaccagaactcaggaaaaaagtcatgcctgcagtagtcatcaggcagcggaaaccatttagaaggaaggatggtgtcttcatttactttgaagataatgctggggttatagtcaataacaaaggtgaaatgaaaggatcagccatcact

SEQ ID NO: 378 - DNA, 22 bp, Artificial Sequence
  primer
  misc_feature (1)..(22): forward primer
aaaatgtccaagagaggacgtg

SEQ ID NO: 379 - DNA, 22 bp, Artificial Sequence
  primer
  misc_feature (1)..(22): reverse primer
agtgatggctgatcctttcatt

SEQ ID NO: 380 - DNA, 667 bp, Diabrotica virgifera
  misc_feature (1)..(667): WCRW transcript ta01259.001_diavv
aaggtattgtctctttaaggaatgcacagggatctaatgactggcaggctcgtttgcatctggttgcaaacgtcacgggggtctgggggctgtcaaaataagttctttcaataatacaaaatgtccaagagaggacgtggtggttccgcgggagcgaagtttaggatctcccttgctcttcctgtaggagcagtaattaattgtgcagataatacaggagcaaagaacttatatgttatcgctgtacaaggtattggtggacgacttaaccgtctgccagctgcaggatctggtgacatgattgtagccacagtcaaaaagggtaaaccagaactcaggaaaaaagtcatgcctgcagtagttatcaggcagcggaaaccatttagaaggaaggatggtgtcttcatttactttgaagataatgctggggttatagtcaataacaaaggtgaaatgaaaggatcagccatcactggtccagttgcaaaagaatgtgcagatttatggcccagaattgcatcaaatgcaagcagtattgcttgatgtgtatatgtttaagaaaaataaaataggatattgttcttaaaaaaaaaaaaaaaaaatgcgattttttatagaacctatgtaagtttacaatttattcatgaaataatgtaaaaatgacagg

SEQ ID NO: 381 - DNA, 520 bp, Diabrotica virgifera
  misc_feature (1)..(520): RNAi target sequence
ggcccaaacaactgtaagacagggtgctcaaggaggaactactgtataccccggtatgcaaaacacttacagagctactgcccgcccaccaaatcagtcaacaaccatgcgtagcaacatgagtgtacctaggcaaattactggacaacaaccacaaaatgcaattgtacctgctgctgttaacagaacagccaacttctaatacacttcaaacatgagaaatccaccacaacctttgggaggtttaccaggtgctgctgctccagtacagcaggctgtacacactcaaggtcaggaaccattgacagcaaccatgttggctgctgctccaccacaggagcaaaaacagatgttgggtgaaaggttgtttccacttatccaacgcatgtatccagacatggcaggtaaaatcactggtatgttattggagattgacaacactgagctgctacacatgttggaacaacaggagtcccttaagaacaaagtggaagaagcagttgctgttttacaagcccat

SEQ ID NO: 382 - DNA, 20 bp, Artificial Sequence
  primer
  misc_feature (1)..(20): forward primer
gcccaaacaactgtaagaca

SEQ ID NO: 383 - DNA, 22 bp, Artificial Sequence
  primer
  misc_feature (1)..(22): reverse primer
atgggcttgtaaaacagcaact

SEQ ID NO: 384 - DNA, 2656 bp, Diabrotica virgifera
  misc_feature (1)..(2656): WCRW transcript ta16449.001_diavv
cgcattttttttttttttttttgacttctgacaaatagactttttaaacctattgtgaagaaaaactattaaaaaaacaaaaaaaattgtaaaatagtgtaaaaaagtaaaaaaatatccaacgaagatgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtaggcctatccgcatcatgtggtctcaacgtgatccatcattgagaaaatctggcgttggaaatgtttttatcaagaatttagatcgttccattgacaacaaggccatgtacgatactttctcagcttttggtaacattcttagttgtaaggtagcccaagatgaaaacagctctagtaaaggttatgggtttgtccattttgaaaccgaagaagctgcaaataagtctattgaaaaggtaaatggtatgttgttgaacggaaaaaaagtatatgtaggccgctttattccacacaaagaaagagaaaaggaactgggagaaaaagccaagctgttcacaaatgtttatgttaaaaattttggtgaagattttgctgaggaacagttaaaggttatgtttgaaaagtatggtaaaattaccagctacaagataatgagtaaagaagatggtaaatcaaaaggatttggttttgtagcctttgaaagttcagaggcagcagaagcggcagttgaagctttaaatggaaaagagttggttgaaggaaaacctttgtatgttggaagagcccaaaagagagctgagcgtcaacaagaactaaaacgtcgctttgaagccttaaaaatggaaagacttaatcgctatcagggtgtaaatctctatgttaaaaatctagatgatacaatagatgatgaacgtctccgtaaagagtttactccttttggaaccataacatctgccaaagtgatgttggaagaaggtagaagcaagggttttggttttgtatgtttttcctctccagaagaagctacaaaggcggtaacagaaatgaatggcagaattgttggttctaagcctttatatgttgccttagctcagcgtaaagaagatcgtaaagcacatttaacttctcagtacatgcagcgtatggcaaatatgagaatgcaccagatgggtcagttcatacaaccaggtgcatctagcggttattttgttcctaccattcctgccgcacaaagattctatggaccagcacagatgactcaaattcgtgctagtaccagatgggccgcccaaacaactgtaagacagggtgctcaaggaggaactactgtataccccggtatgcaaaacacttacagagctactgcccgcccaccaaatcagtcaacaaccatgcgtagcaacatgagtgtacctaggcaaattactggacaacaaccacaaaatgcaattgtacctgctgctgttaacagaacagccaacttcaaatacacttcaaacatgagaaatccaccacaacctttgggaggtttaccaggtgctgctgctccagtacagcaggctgtacacattcaaggtcaggaaccattgacagcaaccatgttggctgctgctccaccacaggagcaaaaacagatgttgggtgaaagattgtttccacttatccaacgcatgtatccagacatggcaggtaaaatcactggtatgttattggagattgacaacactgagctgctacacatgttggaacaacaggagtcccttaagaacaaagtggaagaagcagttgctgttttacaagcccatcaagccaagcaagctgctactactcagattaagaaagagtagttgctgaagcagtgatgattttatgttttatatttttaagcataaataaaaagtacttgtgcattttcaaaaaaaaaaaaaaaaaatgcgtcaaattagctgattgtagcttaaacataatctttaaatctaatgtgtttattattacagtttttgtttagcatcaaacattgcttacatctccatattcacttcttgattattgtttaatagtttgtcatttgatttaaattatacaacaaagttaatgctttgtcatttattcagtttttgtattataaaaaaatatacaattctggaccttggaggtaaactacattatgttaacatggtgttgttttgaataagttcccttaatccacttattttattagttggattatacaaatttggttatatattattcaaatatggttacattgtttttcaaacaattgagatttttataacactcaaagtgctctactgtaatttacctccgaggtccagatatgtttttggaaatcgtcaaagtctcagtacggctagctttgctacatttgtaacacatgattaatttcatttagaatagttgattacaaaaatgccacaaggaaatagcttcagaacatttcattttttaattattataaattcattttagaaagcattatcaaattgtag

SEQ ID NO: 385 - DNA, 490 bp, Diabrotica virgifera
  misc_feature (1)..(490): RNAi target sequence
tcaggtatgccagtttattttggaagattatgtaatgtctgggcaaggagcctgggccaacatctgcgtcacacaacccagacgtatatcagccgtttcggtatcagaaagagtggctgccgaacgatgtgaagagctcggtcagtctatcggttactcagtgcgttttgaatcagctttacctaaaccgtacggatcagtaatgttctgtacagtaggagtgttgttgaaaaagttggaaaatggtcttagaggagtcagccacgttattgtagatgagattcacgaacgagatgtcaatagtgactttattatggttgttttgagagatatgatccacacatatcccgatttaagagtaattcttatgtctgctaccatcgatacaactttattctctaaatatttcaacaactgccccgttatcgaaattccaggaagagcttttcctgttaaacagtatttcttggaagatgctattgaactcacg

SEQ ID NO: 386 - DNA, 23 bp, Artificial Sequence
  primer
  misc_feature (1)..(23): forward primer
tcaggtatgccagtttattttgg

SEQ ID NO: 387 - DNA, 22 bp, Artificial Sequence
  primer
  misc_feature (1)..(22): reverse primer
cgtgagttcaatagcatcttcc

SEQ ID NO: 388 - DNA, 4007 bp, Diabrotica virgifera
  misc_feature (1)..(4007): WCRW transcript ta01430.001_diavv
gggggccacaagcacaagctaaagcgacacgccgggatttggttccggtagaaaaattcagaaaaaatctattttttcgtttaaacaagcataaaaaataattaccaaatattaataaaacatttacaatcgtggtaaacgtattttgaattcatcatgtctgatctaaaatcctttctaaaccaatggtgtcagaagaataaaaaggaaccagcttatgaagtgagacccacgggacccaagcataggcagagatttctctgtgaactaagaattgatggctacaactatgttggagcaggaaattcaaccaacaaaaaggatgcacaatctaatgcttcaaaggatttcatctctttcttggttcggcaaggaatgattaacaaaaatgaggtaccagctgatattgatgctgctcctacacctgccattcaccacggccaacaagaaatgacaggtggcgggccgcaacatcaagtgtttgagaaaggtatgggtcctgccaattttggtgaagcataccgtcctcgtggtcgagaagatggagaatggcattatatggacagagctcaagaacagaaacgaatggaagaagcagaagatttagatgtgaatgctcaaattcatggaaattggactgtagagaatgccaaatctaagctacatcaattcatgcaagccaataagattaacacggattataaatatacacaagttgggccagatcactctagaacattcgtcgcagaactcagtttctatgttaaacaacttggaagaactattcatggaagggatactggatctaataaacagactgcaagtaaaagttgtgccctatcagttgtgcgacaactttttcacttgaaagtcattgaagctttttcaggaacattaaaaaaagaaaagaagtcagcaacagaaatgcctcctttccaagtaagactaagtcctaaattgaaggatcaaatttctgactgtttgaggtcattaaacgtgactcccactccagtcacctctaatcaagtggacgataaaggcgaacctgtacccgtgtctctactaagcagccacgttttagacgactttcatcccgcaaaacccacagcggctggtgtggttccgtggtcgccacctcaaccaaactggaactgctggacaggttgtaatatagacgaagggtatttagctagtgctacgttggatgatttaagtgaacagatgcttactgattggaaacacagaacagcgaatgattcttcgctgatcactagtatgcaagacagaatgattttgccggtatatacgaagaaatcagagattatggaagctatcaacgaacatcctgttattatcataaggggaaatactggttgcggtaaaacaactcaggtatgccagtttattttggaagattatgtaatgtctgggcaaggagcctgggccaacatctgcgtcacacaacccagacgtatatcagccgtttcggtatcagaaagagtggctgccgaacgatgtgaagagctcggtcagtctatcggttactcagtgcgttttgaatcagctttacctaaaccgtacggatcagtaatgttctgtacagtaggagtgttgttgaaaaagttggaaaatggtcttagaggagtcagccacgttattgtagatgagattcacgaacgagatgtcaatagtgactttattatggttgttttgagagatatgatccacacatatcccgatttgagagtaattcttatgtctgctaccatcgatacaactttattctctaaatatttcaacaactgccccgttatcgaaattccaggaagagcttttcctgttaaacagtatttcttggaagatgctattgaactcacgaagttcgtgccacccactgataccagaaaaagaaaaaataaaggtggtaaagatgatgacgaagaagaaagtacaggcgttgaagaacctgacgaaaatttaaacaaggttgtaggaggaaattattcagatctgaccagaaacgtcatgtctagactgaatgaaaaagaagtgagttttgagcttctggaagctcttttagactacatcaaaacacaatctatacctggagctgtattagttttccttcctggctggaatttaatcttcgctatgatgaaacatcttcaaaatcaccccgtttatggaggaagtcagtacagtattttacccttacattcccaaatccctagagaagatcagaaaagggtctttcaacctgttcctgaccacgtaacaaaagtcattcttgcaacaaatatcgccgaaacttccatcaccataaacgacgtagtgtttgtgattgacagttgcaaagcaaaaatgaagatgtttacttctcacaacaatatgactagttatgctacggtttgggcttccaggacaaacttggaacagagaaaaggtcgagctggtcgtgttaggccaggtatttgtttccatttgtgttccaaggccagattcgacaaacttgacgaacatatgacaccagagatgtttagaactcccttacacgagctggctttgagcataaagctgttacgtttgggctcgataggtcatttcctgtcaaaggctattgaacctccaccattagatgccgtcatcgaagcggaagtgctattaagagaaatgaaatgtctggatcaaaacgatgagttgactcctctgggtagaatcatcgccaagcttcccattgaaccgagattggggaaaatgatggttttgggttgtgtatttatgtgtggaggaccattggctacgatggctgcaaactcttctacattccctgaaatattcacgctagacatgggccaaagacggttaagctatcatcaaagagccttatctggggacaggcactccgatcatgttgcgatgttaacagcatttgagctgtgggatcaagccagacaaggtggagaagaagcagaattaaggttttgcgatttcaaaggcatcagtatgccgactatgagagtaacttgggaagctaaacatcaactacaacaaatcttgaataatgtaggttttccagaagaaactatggcgctatttcctatggaaactgttggtccagatcccagacttgatgttgtaatgtctcttatgtgttacggattatatccaaacgtttgtttccacaaggacaaaagaaaggtattaacaacagaaagcaaagccgcacttatccacaaaacttccgtcaactgcagtaaccaggatcaaggatttccatacccattctttgtatttggagaaaaaatcagaaccagagctgtatcttgcaaacagatgactatggttacaccccttcatcttctgctgttcggttcccgaaaagtagaatgggttgataacgtggttaggttggacaactggatcaatttggacatggatcccgaggtagcttccatgatagtggctctaagacctgcgttggaaagtttagttattagaacttctcagtctccagaagcaatcttggaaatgggagaaactgacgttaaggttgtgtcaacgattaaagaaatatgcagattgcacgcaggaagttttgaactagaaagagccaaaggtagcctgcttcaatcaaataggcctcccagaggacacactctcggagggttcagtggaccttctcccaaattcttcagaggtggctttaatagtcgaggtggtggtggaggtttcagaggtggattccgtggcgatagaaatgggggcggttttggcggcggcagaggtggattccgaggtggtcgaggcggatttggaggaggcggtggtggctttggcggttcccgtggtggaagatattagatatcttataatatatatagatataacttaattactaatgtttcttaggtatttattgcattttaaaaatgactgtttccaaacaatgttttgcaatgtattagtatgacagtgtatcagttaatttaagatttagtgtttaattt

SEQ ID NO: 389 - DNA, 658 bp, Diabrotica virgifera
  misc_feature (1)..(658): RNAi target sequence
gggggacttcattccagtcttgtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagcagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtacaactggtattgtgttggattctggtgatggtgtatcccacactgtcccaatctatgaaggttatgctcttcctcatgcaatccttcgtttg

SEQ ID NO: 390 - DNA, 22 bp, Artificial Sequence
  primer
  misc_feature (1)..(22): forward primer
cttggtacagcagtttcagtgc

SEQ ID NO: 391 - DNA, 22 bp, Artificial Sequence
  primer
  misc_feature (1)..(22): reverse primer
gcatgaggaagagcataacctt

SEQ ID NO: 392 - DNA, 1534 bp, Diabrotica virgifera
  misc_feature (1)..(1534): WCRW transcript ta02481.002_diavv
ggattccagtcttgtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtacaactggtattgtgttggattctggtgatggtgtatcccacactgtcccaatctatgaaggttatgctcttcctcatgcaatccttcgtttggacttagctggtagagacttgactgattacctcatgaaaattttgactgaacgtggctactctttcaccaccacagcagaaagagaaattgttagagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgatatccgtaaggacctatatgccaacactgtactctctggaggtaccaccatgtaccctggtattgctgatagaatgcagaaagaaatcactgccttggctcctagcacaatgaagattaagatcatcgccccaccagaaagaaaatactctgtatggatcggtggttccattttggcctctctatccaccttccaacaaatgtggatttccaaacaagaatatgatgaatctggtccatccatcgtccacagaaaatgcttctaatttgtttttgtccgcatttatattctttatttctatttacataagcccgcccattttccgggcgcgaactgccgtgtttatcgtatgggatcgagaccataaaatatccacactaggccaaagtattactatcttaatttttgtaatttattacctgtgcaaagtaagactattatattattaggctaatactatgggaaaataaaaaaaatagtaaaactcaaaaaaaaaaaaaaaaaatcagtttacctttctaataaaataaataaaacaaaaaaaaaaaaaaaaaa

SEQ ID NO: 393 - DNA, 601 bp, Diabrotica virgifera
  misc_feature (1)..(601): RNAi target sequence
tgctccaagatgaaggtactcattcttctttccgttgttgccttgagcagctgcttaccagcatccagaaatcaacaatacgttgatgcagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttcctgaacacttatggagctccaacgagcaaattgtaccatacatgatgaactacttcaaccaatacccaatgaaatacaacgacattatgcatgaagttatgcaaaccccatgggctcaccaacaacttatgttccacgttatgtctgaattataccagcacttcggtcaag

SEQ ID NO: 394 - DNA, 22 bp, Artificial Sequence
  primer
  misc_feature (1)..(22): forward primer
tgctccaagatgaaggtactca

SEQ ID NO: 395 - DNA, 22 bp, Artificial Sequence
  primer
  misc_feature (1)..(22): reverse primer
cttgaccgaagtgctggtataa

SEQ ID NO: 396 - DNA, 1208 bp, Diabrotica virgifera
  misc_feature (1)..(1208): WCRW transcript ta08003.008_diavv
ggggggacatttcagtacactgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttcctgaacacttatggagctccaacgagcaaattgtaccatacatgatgaactacttcaaccaatacccaatgaaatacaacgacattatgcatgaagttatgcaaaccccatgggctcaccaacaacttatgttccacgttatgtctgaattataccagcacttcggtcaagccccatggtcccacgaacaaataatgaaccagatcatgcaacaccaatacctctacggtacaaccttatcccaacaacaactccaacaattggtagaattcgtactccacattcaatacgaacttactcctttacattaccaacaacttgaacaagttcaaccctggaaccgtgaacaagtactttcatggaaccaaggacaagtactcccatgggcctacagacaacttcttccattgaactatgaaaccgttttaccatggacccgccagtattccgcacaaaacaacatgaacctagagtcccaatacaactacaatctccaccaacaacaaatgccattgtcccaatactggaaccagagatacggacaacaatacccacaacattatgaagccatggaacaacccggatggtggaaccaagaatggacccaaaacttggttggacaagagaatcattatcctctcttggggcaaaatatgcccttagtatattaaaaagtattctgttctaagcatatgatttaaaataaaaaaaggcatatatacttgttagttttatttttaacccgtatacaaagagtt

SEQ ID NO: 397 - DNA, 600 bp, Diabrotica virgifera
  misc_feature (1)..(600): RNAi target sequence
atttctttcaaactgggattcggtgaagacgtgacagctcagggggcgtttaatgaaaaaactgtgatttattagtgaaatagtggttaaaacccagcaaaatggggattaaatttttggaagttataaagcctttctgcagcatactgcctgaaatagccaagccagaaagaaaaatccaattcagggagaaagtactatggactgcaatcactcttttcatctttttagtatgttgtcagattccattattcggtataatgagttcagattctgcagatcctttctactggattcgtgttattcttgcatcaaacagaggtacccttatggaacttggtatttccccaattgtaacttcaggtctgattatgcagctgttggccggtgccaaaattatcgaggttggtgacactccaaagacagagccttattcaatggtgcccaaaaattgtttggtatggttattactgtcggtcaagccatcgtgtatgtaatgacaggcatgtatggtgatccggctgaaattggagctggagtgtgccttctcatcatcatccaactgttcgtcgccggtctcattgtattgcttctcgatga

SEQ ID NO: 398 - DNA, 22 bp, Artificial Sequence
  primer
  misc_feature (1)..(22): forward primer
atttctttcaaactgggattcg

SEQ ID NO: 399 - DNA, 22 bp, Artificial Sequence
  primer
  misc_feature (1)..(22): reverse primer
tcatcgagaagcaatacaatga

SEQ ID NO: 400 - DNA, 2110 bp, Diabrotica virgifera
  misc_feature (1)..(2110): WCRW transcript ta03313.003_diavv
ccaacatcatcgatcacgtgacccgtgtgctgtgctacgtgtacgacgtgtagacgtaaaacagagacaagaagtaccgtaatttctttcaaactgggattcggtgaagacgtgacagctcaggggggcgtttaatgaaaaaactgtgatttattagtgaaatagtggttaaaacccagcaaaatggggattaaatttttggaagttataaagcctttctgcagcatactgcctgaaatagccaagccagaaagaaaaatccaattcagggagaaagtactatggactgcaatcactcttttcatctttttagtatgttgtcagattccattattcggtataatgagttcagattctgcagatcctttctactggattcgtgttattcttgcatcaaacagaggtacccttatggaacttggtatttccccaattgtaacttcaggtctgattatgcagctgttggccggtgccaaaattatcgaggttggtgacactccaaagacagagccttattcaatggtgcccaaaaattgtttggtatggttattactgtcggtcaagccatcgtgtatgtaatgacaggcatgtatggtgatccggctgaaattggagctggagtgtgccttctcatcatcatccaactgttcgtcgccggtctcattgtattgcttctcgatgaacttctccagaaaggatatggtttaggttctggtatttccctcttcattgcaacaaacatttgtgaaactattatttggaaagccttctcaccagcaacagtaaacactggaagaggaacagaatttgaaggagctgtcattgccttattccacttgttgaccaccagacaagacaaaatcagaggattacgtgaagctttctacaggcaaaatcttcccaatttgatgaacttgttggcgacagtactcgtttttgctatagtaatatacttccaaggattcagagtagatctacccatcaagagtgcaagataccgtggacaatattccagctatccaatcaaattgttctacacttcgaacatccctattattctacaatctgctcttgtatctaacttgtatgtcatctcacagatgttggctgttaaattccaagggaacttcttaattaatctattaggagtctgggctgacgttggaggcggtggcccagctaggtcttaccccattggaggattatgttactacttatctccacctgaaagtgtaagtcacattctagaagatccaatccacgcaatgctctacatcgtcttcatgttgggatcttgtgctttcttctccaaaacatggatcgaagtatctggaagctcagccaaagatgtcgctaagcaattgaaagaacaacagatggtaatgagaggacacagagataactccatgattcacgaattgaacaggtacattcccaccgccgcagcttttggaggtctctgtattggagccttgtcagtactcgctgatttcatgggagccattggttcaggtactggtatcttgttagctgtcaccatcatctaccaatacttcgaaatcttcgtcaaagaacaaagcgagatgggtggaatgggagcgttactcttctagataaattgaagatatcacaaagctatagcttgactgatattgtgattttgtttggtaaatagtaactattgtggttattatttgtttagtttttgtacctcagtgtctccactatagttattatttatgtggaacaacttatatgtcactttgtataaagtgtgaaacatttttttgtactaaaagattgaaaatagacaaatatatttcattgtacatttacatgattttgtgtttaagaagcgagttatttataatgtgcggatgtcccatactattagtttattttttacattttttcattctcgttcatgcagtacggttgtgtattgatcatttattatttgttgttagatataatttattttaaatacagaaatttctgaaatcctgtttttcatttgatgctaatgtatactgtaaatgtttcgagataagggcatctatcatttaaatgttgaaatattattgaaatgtacaaatttacatgttctttt

SEQ ID NO: 401 - DNA, 707 bp, Diabrotica virgifera
  misc_feature (1)..(707): RNAi target sequence
gggggaccttttatatttgacatcctgaaagatggttgagaaaaaggctgtacagaagcccgctggggatgcaccaaaaaaggtgcacaaaccaggaaaacctagaaattatgatttgggaaatggagtactcagattttctagatctaaaatgttccacaaaaaagcattgtacaaatttgttggcaagaaggtagaagctaccaagaaacctcaaaagccccaggttattgaaaaaccaattggtggagagaaaaatggaggaaagagatttgttttggtcaagaaacgtagggcatcctatccaacccaagacaaaattaaggccaggccagctaggagaacatttagccaacacacaaggtctattagaaatacaatcactccaggaacagttctcatccttttagctggttctcacaaaggaaagagggttgtattccttaaacaactgtactctggtctacttttggtaactggaccttttggaatcaatgcttgcccattgaggcgcattagccaacgatatgtaattgctacatctaccaaaattgacgttagtggagtacagctgccagaaaaccttaatgatgaatattttgcaagaaagaggcagaagagatccaagaaagaagaaggtgatattttccaatccaaaaaagaaggttacaaagtaagtgaagataggaaagctgaccaaaagaaag

SEQ ID NO: 402 - DNA, 18 bp, Artificial Sequence
  primer
  misc_feature (1)..(18): forward primer
gaccttttatatttgaca

SEQ ID NO: 403 - DNA, 22 bp, Artificial Sequence
  primer
  misc_feature (1)..(22): reverse primer
ctttcttttggtcagctttcct

SEQ ID NO: 404 - DNA, 1036 bp, Diabrotica virgifera
  misc_feature (1)..(1036): WCRW transcript ta17558.001_diavv
aaggagagggaggttttcctgtttgtgcaccttttttgtgcagacagaacgaccacctggacacgcatgctatgggggaccttttatatttgacatcctgaaagatggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcactccaggaacagttctcatccttttagctggttctcacaaaggaaagagggttgtattccttaaacaactgtactctggtctacttttggtaactggaccttttggaattaatgcctgtccattgagacgtattagccaacgttatgtaattgctacatctaccaaaattgacgttagtggagtacagctgccagaaaacctaaatgatgaatattttgcaagaaagaggcagaagagatcaaagaaagaagaaggtgatattttccaatccaaaaaagaaggttacaaagtaagcgaagataggaaagctgaccaaaagaaagtagatacacaagttctggctgcaatcaagaagcaatcagaccgcaaagtacttttagcttatttgtcagccatgtggggactcagatcatcacagtacccacacagattgaagttttagataagagataccataaattgtttatcttttgacttgtatagagaggaaagtgataaataaattatggatttataaatgaggtttttttatgtgactgttgttataatacaataatttaattcttaaaaaaaaaaaaa

SEQ ID NO: 405 - DNA, 671 bp, Diabrotica virgifera
  misc_feature (1)..(671): RNAi target sequence
gggaaccttattttatggtgtcgtgccagcagaaaattttaaaaattcttgtaattgtttagacatttcgcaacaattgtgaacaattttggaaaatattgcttgaaagctataattctagatgtaagagcaaagttttgtagtcaaaatggctggagtattcgatttagaactgcatgatgttgaaactgtagaagtagatgattcagacgatgcaatcgaaattgaagaggatgaatatgatcaaaatcctaatattaatgcaattgtagaatccgatgatacagaaacggttcatctgactgaacaaattgtgaacccgggccaggaaaaaaccggaccccatgactttgaattacgcaaagtcctgggcaaaggaggttatggcaaagtatttcaagttagaaaaattacggggaaagatgccaatactgtctttgccatgaaggttctccgcaaggcttccatagttagaaatcaaaaagatactgcccatacgaaagcagaacgaaatattttagaagaagttaagcatccttttatagtggatttgatatatgccttccaaacgggtggaaaattgtacttaattttagaatacctcagcgggggcgaactttttatgcatttagaaagagaaggaatatttttagaggataccgcttgctttt

SEQ ID NO: 406 - DNA, 21 bp, Artificial Sequence
  primer
  misc_feature (1)..(21): forward primer
gaaccttattttatggtgtcg

SEQ ID NO: 407 - DNA, 22 bp, Artificial Sequence
  primer
  misc_feature (1)..(22): reverse primer
aaaagcaagcggtatcctctaa

SEQ ID NO: 408 - DNA, 2032 bp, Diabrotica virgifera
  misc_feature (1)..(2032): WCRW transcript ta00443.001_diavv
gggggagacataaccttattttatggtgtcgtgccagcagaaaattttaaaaattcttgtaattgtttagacatttcgcaacaattgtgaacaattttggaaaatattgcttgaaagctataattctagatgtaagagcaaagttttgtagtcaaaatggctggagtattcgatttagaactgcatgatgttgaaactgtagaagtagatgattcagacgatgcaatcgaaattgaagaggatgaatatgatcaaaatcctaatattaatgcaattgtagaatccgatgatacagaaacggttcatctgactgaacaaattgtgaacccgggccaggaaaaaaccggaccccatgactttgaattacgcaaagtcctgggcaaaggaggttatggcaaagtatttcaagttagaaaaattacggggaaagatgccaatactgtctttgccatgaaggttctccgcaaggcttccatagttagaaatcaaaaagatactgcccatacgaaagcagaacgaaatattttagaagaagttaagcatccttttatagtggatttgatatatgccttccaaacgggtggaaaattgtacttaattttagaatacctcagcgggggcgaactttttatgcatttagaaagagaaggaatatttttagaggataccgcttgcttttatttatccgaaatcattctcgccctagaacatttacatggacaaggaattatttatagagatctaaagcctgaaaatattttacttgacgcccacggtcacgttaaattgacagatttcggtctgtgtaaagaacacattaacgaaggcatattgacccacacgttttgtggaactattgaatatatggcacctgaaattttaactagacatggccatggaaaagaggttgattggtggtcattaggggcattgatgtacgatatgttaactggtgcacctccgtttaccgctgaaaatagaaaaaagacaatagaaaaaattactaaagggaaaactaaaccttccgccttatttgaccgccgatgctcgtgatttagtacgcaaattactaaagaggcaggttccttcgagattaggggctcctcccgatgatgcaaatgctgtcaaacgacatcaattcttcaaacacatcgtctgggatgatgtcctgagaagaaaatatgaacctccatttaaaccaagtcttgctagtgatgatgatgtctctcagtttgataccagatttacaaaacaaactccagtagattcgccggacgaatcgactcttagtgaaagtgccaacatgatattccagggctttacctacatagcaccctccgtcttggaagatatctataaaccaacgatagtaaaagctcgctctccccgtaaaggttcctatcgccctcatttcggttttacgcctactcatcatagtcatcccaataacctggatccgaattgcagctacgtagcaggaatgtcttctgcgcacgctgcgcactccaatcacgtgcctccacatgctgcacacggacttgcgcatcatccacatgcgcaccatcataacccgtttgctccacaagcagtctttaatataccaacaaatgcatgcgcagacgagatgatggaagtcggcagcggactacctcatgtatagtatatatatgatagattaggaccggtctttttatataagagttgataggaagtttttgataggtatcgattcattagttcaattttgttttttatgattaatattattttgactggaggtgtcaaatttcctaatgatagatttagcttcccttgatcgatcacattataaaatacaataatttttgaactgaagtatcgcatgtgtcaaaagttgatatctttggaaaataaagactatattatgtgttgttatacatttaatttgttgaagtctagttacaaaaggctcaattttgttaaaataggtttggcaagtgcacctaggtcagtatgggttgcgaatttaaaatggttataaaaaatatgctca

SEQ ID NO: 409 - DNA, 612 bp, Diabrotica virgifera
  misc_feature (1)..(612): RNAi target sequence
gagcttgcgatttttatttttgaaaaatagagagtattctctaatatttaaggacagtatggaagacgattgggctgtggataatcagagtggtggagttgtcgccccaaaaattgcagaactacctgaaattaagttgttcgctagatggaactgcgatgatgtccaagtttcagacatgtcccttcaggactacattgcagtgaaagaaaaaaatgcaaagtatttaccccattcagctggtagatatgctgcaaaaaggttccgtaaagcacaatgcccaatcgttgagaggttaacaaactctctaatgatgcatggacgtaacaatggtaaaaaattgatggctgtcagaattgttaaacatgcttttgaaattatccatttactaactggagaaaatccattacagattttagtttctgctattatcaattcaggacctagagaagattctactcgtattggtagagctggtactgtaagaagacaagctgttgatgtgtcacccttgagaagggttaaccaagcaatttggttgctctgcacaggtgctagggaagcagcattccgtaatattaaaactattgctgaatgtttggctgatgaatt

SEQ ID NO: 410 - DNA, 23 bp, Artificial Sequence
  primer
  misc_feature (1)..(23): forward primer
gagcttgcgatttttatttttga

SEQ ID NO: 411 - DNA, 22 bp, Artificial Sequence
  primer
  misc_feature (1)..(22): reverse primer
aattcatcagccaaacattcag

SEQ ID NO: 412 - DNA, 780 bp, Diabrotica virgifera
  misc_feature (1)..(780): WCRW transcript 454run3_isotig03469
aagttttatccatatttattattggaaataaaatataaaatgagaaataaatttaacggttggatttggctacacgttcaagttcatccttctttttgatagcatatgaatttgatgatcccttggcagcattgattaattcatcagccaaacattcagcaatagttttaatattacggaatgctgcttccctagcacctgtgcagagcaaccaaattgcttggttaacccttctcaagggtgacacatcaacagcttgtcttcttacagtaccagctctaccaatacgagtagaatcttctctaggtcctgaattgataatagcagaaactaaaatctgtaatggattttctccagttagtaaatggataatttcaaaagcatgtttaacaattctgacagccatcaattttttaccattgttacgtccatgcatcattagagagtttgttaacctctcaacgattgggcattgtgctttacggaacctttttgcagcatatctaccagctgaatggggtaaatactttgcatttttttctttcactgcaatgtagtcctgaagggacatgtctgaaacttggacatcatcgcagttccatctagcgaacaacttaatttcaggtagttctgcaatttttggggcgacaactccaccactctgattatccacagcccaatcgtcttccatactgtccttaaatattagagaatactctctatttttcaaaaataaaaatcgcaagctcttgctgaacgacggcgtgaaccggaaaaggt

SEQ ID NO: 413 - DNA, 630 bp, Diabrotica virgifera
  misc_feature (1)..(630): RNAi target sequence
gcttctttttcgttggatgtctttgtaggttttaaaaatgggagcctacaagtatatacaggagttgtatagaaaaaaacaaagtgatgttcttagatttttactgagagtgagagtctggcaatatcgccaattgactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctacggtaaacccaaaagccatggagttaatgaattgaaacctgtccgtaacttacaagctattgctgaggaacgtgtaggaagaaggtgtggtggattaagagtcctaaactcctactgggtagcccaagattcaacatacaaatattttgaaatcattttggtcgacccctcacataacgctattcgcaaggaccccaaaattaactggattgtcaactcagtacacaaacacagagaactccgtggcaaaacttcctctggcaaatcatctcgtggtttgggcaagggtcacagatactctcaaaccaagggaggatccaggcgtgccgcttggctcagaaggaactcact

SEQ ID NO: 414 - DNA, 22 bp, Artificial Sequence
  primer
  misc_feature (1)..(22): forward primer
gcttctttttcgttggatgtct

SEQ ID NO: 415 - DNA, 22 bp, Artificial Sequence
  primer
  misc_feature (1)..(22): reverse primer
agtgagttccttctgagccaag

SEQ ID NO: 416 - DNA, 1374 bp, Diabrotica virgifera
  misc_feature (1)..(1374): WCRW transcript ta18374.001_diavv
tatataactcggattaccacagtcaaagtgcataaaacttaacaatacgcaaaaaccgtagcagtccgtttatttctttcctgcggccttggctggagccttcttggccttcttaggctttgatttcttatctttcaagatttgtgcccttctcctttcttgcaattttctggatctaatcacgacgttgtcggcactcacggtaataccacgtttcttggccaaaagttcttccctgtttaactgtctcttttgattcttcaaaatggcttcacgtttgagtacagcagcatatggattcaacttaagcatggccttagcgttggtcaatggattgagacgacgtacacgacgtacaaccttcttttgaggagcacgtaatacagctttgatttcatcagccttcaacaatctagatagatcagtgttggccattttaggctggggtagattgtaacccttcttttccaatgatgctgttttccatgtgccgaacaatttatctaaacgttggaaagctgattcagtccaaataacaaagcgacctacatgaccaccaggagcaagtttcaacaaatttaacttctgtacgctaatgaggtcaatgcctgggatgttacggaaagcacgacgaagacctacaagggggacttgcgcgttgaactttctttttcgttggatgtctttgtaggttttaaaaatgggagcctacaagtatatacaggagttgtatagaaaaaaacaaagtgatgttcttagatttttactgagagtgagagtgtggcaatatcgccaattgactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctacggtaaacccaaaagccatggagttaatgaattgaaacctgtccgtaacttacaagctattgctgaggaacgtgtaggaagaaggtgtggtggattaagagtcctaaactcctactgggtagcccaagattcaacatacaaatattttgaaatcattttggtcgacccctcacataacgctattcgcaaggaccccaaaattaactggattgtcaactcagtacacaaacacagagaactccgtggcaaaacttcctctggcaaatcatctcgtggtttgggcaagggtcacagatactctcaaaccaagggaggatccaggcgtgccgcttggctcagaaggaactcactgcaattgcgcagaaaacgttaaaatttatttttttataattagaccaataaaatttacggattaaaaaaaaaaaaaaaaaa

SEQ ID NO: 417 - DNA, 663 bp, Diabrotica virgifera
  misc_feature (1)..(663): RNAi target sequence
  misc_feature (570)..(570): n can be any nucleotide
gggcgaaactgttcttcattatcctttctaggtcgtgtaaaatacgtgaaggccaaaatgggtagacgacctgcgaggtgctaccgttattgtaaaaacaaaccctaccccaaaagtcgtttctgcagaggtgttccagatccaaaaatccgtattttcgatttgggtaagaagaaggcttccgtagaagactttcctctatgtgtacatttagtttctgacgaatatgaacagctaagttctgaagcattagaagcaggacgtatctgttgtaacaaatatttggtaaagaactgtggtaaagatcaattccacattcgtatgagactccatcctttccatgttatcagaatcaacaagatgttgtcatgtgctggagctgatagactccagactggaatgagaggagctttcggcaagccccaaggtacagttgctcgtgtccgcattggtcaacctattatgagtgtacgctctagtgatcgtttcaaggctgcagttattgaggctctccgtcgtgccaagttcaagttcccaggtcgtcaaaagatctatgtatcgaagaaatgnggattcaccaagtatgaacgtgaacaatatgaaaacttaaaacaacaaggtagattagctcctgatggttgcaatgttcaatacaggccagag

SEQ ID NO: 418 - DNA, 20 bp, Artificial Sequence
  primer
  misc_feature (1)..(20): forward primer
gcgaaactgttcttcattat

SEQ ID NO: 419 - DNA, 22 bp, Artificial Sequence
  primer
  misc_feature (1)..(22): reverse primer
ctctggcctgtattgaacattg

SEQ ID NO: 420 - DNA, 726 bp, Diabrotica virgifera
  misc_feature (1)..(726): WCRW transcript ta04337.003_diavv
gaaggtttgtttcttaatttattttaacaatcttacgtttttagttgtagtgatatatttttataaactaaatactgaatacgtaataacgtatatgtgttagttttttaatctacatatttattttctattttcaggccaaaatgggtagacgacctgcgaggtgctaccgttattgtaaaaacaaaccctaccccaaaagtcgtttctgcagaggtgtcccagatccaaaaatccgtattttcgatttgggtaagaagaaggcttcagtagaagactttcctctatgtgtacatttagtttctgacgaatatgaacagctaagttctgaagcattagaagcaggacgtatctgttgtaacaaatatttggtaaagaactgtggtaaagatcaattccacattcgtatgagactccatcctttccatgttatcagaatcaacaagatgttgtcatgtgctggagctgatcgactccagactggaatgagaggagctttcggcaagccccaaggtacagttgctcgtgtccgcattggtcaacctattatgagtgtacgctctagtgatcgtttcaaggctgcagttatcgaggctctccgtcgtgccaagttcaagttcccaggtcgtcaaaagatctatgtatcaaaggaaatggggattcaccaagtatgaacgtgaacaatatgaaaacttaaaacaacaaggtagattagctcctgatggt

SEQ ID NO: 421 - DNA, 625 bp, Diabrotica virgifera
  misc_feature (1)..(625): RNAi target sequence
gcgaaagttgtgtcttgaaaagtaaaaatgacgtctaaagtatctcgtgatactctatacgagtgtgtgaatggagtcttggaaaatgccaaggagaagaaaaggaactttttggaaaccgtggaactccagatcggtcttaagaactacgatccccaaaaggacaagcgtttcagcggaaccgtcaaactaaagcacattcctcgtccaaagatgcaggtatgcatcttgggagatcagcaacattgtgatgaagctaacgctaacaatgttccattcatggatgtagaagccttgaaaaaattgaacaaaaacaagaaattggttaagaaactagccaagaaatatgatgctttcctcgcttctgaagctctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctctctgttgctgttggtcatgtaggcatgaatcaagatgaattggttcaaaatgtccatctttcaatcaacttcttggtctcactgttgaagaaacattggcaga

SEQ ID NO: 422 - DNA, 22 bp, Artificial Sequence
  primer
  misc_feature (1)..(22): forward primer
gcgaaagttgtgtcttgaaaag

SEQ ID NO: 423 - DNA, 22 bp, Artificial Sequence
  primer
  misc_feature (1)..(22): reverse primer
tctgccaatgtttcttcaacag

SEQ ID NO: 424 - DNA, 1055 bp, Diabrotica virgifera
  misc_feature (1)..(1055): WCRW transcript ta02345.005_diavv
aagactagtaccttcacataatatggagaatctcctgggttgaacatagaaaaaaatgtataatgtatccataatagaacaactcaatataaaagataggttgcttaaacaaacacaacagagatacagtattttggacacatttcctgaagaacaggaacactttatcattcctggtgcatttcgttaacgtagacaagccgcaaaagttgtgtcttgaaaaataaaaatgacgtctaaagtatctcgtgatactctatacgagtgtgtgaatggagtcttggaaaatgccaaggagaagaaaaggaactttttggaaaccgtggaactccagatcggtcttaagaactacgatccccaaaaggataagcgtttcagcggaaccgtcaaactaaagcacattcctcgtccaaagatgcaggtatgcatcttgggagatcagcaacattgtgacgaagctaacgccaacaatgttccattcatggatgtagaagccttgaaaaaattgaacaaaaacaagaaattggttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtccatctttcaatcaacttcttggtctcactgttgaagaaacattggcagaacgttaggtctctccacgtcaaatcatctatgggacccccacaaagattgtattaagttataatttttatactgagacttttatttacacacttaaatgtgggtatctaaataaacatcgtttttaagttctttaaaaaaaaaaaaaatagaaaaaaaaaatgattggatgtacatattatactaccctactaagtaaaaaaatacatctaaaaaaaaaaaaaaaaaa

SEQ ID NO: 425 - DNA, 693 bp, Diabrotica virgifera
  misc_feature (1)..(693): RNAi target sequence
gggggacattttcgtttgtaaataacaaataacagtaaagtaaagaataaaaattgaagaattttatatgattcctttaattttcgtcttcaaatagcatataagttatattctgagtttataaaattaacaccatgcctacgataatattgctggacgtgtctctttctatgacgaggcctgttcaagttggtgagggctttgaaacagtctcaagaaagcaactggcggaattagggattaatgcatttttggattatcttagcatacattccaaattagagtttatatctttgatggctttttcgtcattgtacgaggagaggtgtccttttaccagagattacaatgctattaaagcagaattaaagaatatagaagactatgataaaacttgcattgaaacagcgcttcatggtgttaatcacatggttcttggagagtgggggaataacacggcttgtcaggtattattagtaacggatggaaatactggaattggaacgaattccttgaaagaagcaattgctacaatgaatcaaaggaataataaaataccatttcctgttcctttttcattcccaggaaaattacatgtggtgtgtctcacttctccctgtgatttaagttttattaaatctaaaccactttttcagaggttgattgatttaagtggttacgacggatcaattt

SEQ ID NO: 426 - DNA, 21 bp, Artificial Sequence
  primer
  misc_feature (1)..(21): forward primer
gggggacattttcgtttgtaa

SEQ ID NO: 427 - DNA, 22 bp, Artificial Sequence
  primer
  misc_feature (1)..(22): reverse primer
aaattgatccgtcgtaaccact

SEQ ID NO: 428 - DNA, 1551 bp, Diabrotica virgifera
  misc_feature (1)..(1551): WCRW transcript ta10911.001_diavv
ggacattttcgtttgtaaataacaaataacagtaaagtaaagaataaaaattgaagaattttatatgattcctttaattttcgtcttcaaatagcatataagttatattctgagtttataaaattaacaccatgcctacgataatattgctggacgtgtctctttctatgacgaggcctgttcaagttggtgagggctttgaaacagtctcaagaaagcaactggcggaattagggattaatgcatttttggattatcttagcatacattccaaattagagtttatatctttgatggctttttcgtcattgtacgaggagaggtgtccttttaccagagattacaatgctattaaagcagaattaaagaatatagaagactatgataaaacttgcattgaaacagcgcttcatggtgttaatcacatggttcttggagagtgggggaataacacggcttgtcaggtattattagtaacggatggaaatactggaattggaacgaattccttgaaagaagcaattgctacaatgaatcaaaggaataataaaataccatttcctgttcctttttcattcccaggaaaattacatgtggtgtgtctcacttctccctgtgatttaagttttattaaatctaaaccactttttcagaggttgattgatttaagtggttacgacggatcaattttggtgccagacaatattcatagtgaatcgagcgtaattagtttatttcagaaacttgctgaagacatgtacacaacatttaagggcaccctaaagtgtggcaatttagaatcaaaaataatattgtcgccagctcctgtggcttatacaaagtttacggattttgaatgcaacacatataacatgtcagaactaatagaagtgtgcggtttcgtatcagttacggatgtagggtcaccgatggccattagccgtcatctaattcttccagccagttctccaaccaaacaagaaagtgttgccaaaaatgacacggaagccaccgaagatgacagcactgacgaagcgaaaataccatcattttgtgtactacttcatggagctttaagagtagagaatatggcagcattggtgaatataggagaaaactggttcggattcgtatattcctgggcagattcgaagaaaaagtcaaatttgatgctaactattttaatgccaggcactgatatcataccttggttaggagatttaaattgtttgggatccgcagaatcttattcgtctgagcaaataggcagttttcctattaaacctatggagaagaggagttactctcagaacggagtcgtttggattcgccaagcaggtctgcaatcggatattcagaaaatattacgacatgcaagaaagttgcccgagaaaactcagcaattctataaggaacttaacaggcttagaaaagcagcaatatccttaggtttcttggatcttttaaacggattggcttatatttttgaacaagaatgtttacagttacctccaagtgcacatccagattgtgctgtccagttacaacatg

SEQ ID NO: 429 - DNA, 651 bp, Diabrotica virgifera
  misc_feature (1)..(651): RNAi target sequence
gggggctcttagttatccatcttggcttcgtttaggttttagcttagcactagcaccacgttttcgttttaagttgactgttgactttggccattgtttcaagtgtagttgtcttatcgttatcgttacaatttgaaatttggattgagtttgagttgttaggaccaggaccaggtttataacacaagtggatatctattcatcatggcaattgattgggaaaaaattgtaactgaactaagtgctgtgttccaagatgagcaagagacatttgcgagagttttgttttatttaggagaagaagaaaaggtgtataaagatgccgataaactaggaccgcagatgaagatcttaatgtcatctatgaaagtagcatctttgtttagtcagtacgccaaacggttagcagaggacacaaagagggctgattcggatgaaaagttcaaacgagtgatgggtctaatctgggcccaaatgatggacgctaacaaacagacagatgacaaagataaaaccccagatgtaagcattattgccaaattagaacacctgtctctagaagcttcgccaggaatggttcgcgccttgagcattattccatatgaaagccaaaagcgttttttagtaatgctcaaagacatcgtaccaaca

SEQ ID NO: 430 - DNA, 22 bp, Artificial Sequence
  primer
  misc_feature (1)..(22): forward primer
gggggctcttagttatccatct

SEQ ID NO: 431 - DNA, 22 bp, Artificial Sequence
  primer
  misc_feature (1)..(22): reverse primer
tgttggtacgatgtctttgagc

SEQ ID NO: 432 - DNA, 1310 bp, Diabrotica virgifera
  misc_feature (1)..(1310): WCRW transcript ta05539.003_diavv
cagagacttcatgctcatgctccttctcttagttatccatcttggcttcgtttaggttttagcttagcactagcaccacgttttcgttttaagttgactgttgactttggccattgtttcaagtgtagttgtcttatcgttatcgttacaatttgaaatttggattgagtttgagttgttaggaccaggaccaggtttataacacaagtggatatctattcatcatggcaattgattgggaaaaaattgtaactgaactaagtgctgtgttccaagatgagcaagagacatttgcgagagttttgttttatttaggagaagaagaaaaggtgtataaagatgccgataaactaggaccgcagatgaagatcttaatgtcatctatgaaagtagcatctttgtttagtcagtacgccaaacggttagcagaggacacaaagagggctgattcggatgaaaagttcaaacgagtgatgggtctaatctgggcccaaatgatggacgctaacaaacagacagatgacaaagataaaaccccagatgtaagcattattgccaaattagaacacctgtctctagaagcttcgccaggaatggttcgcgccttgagcattattccatatgaaagccaaaagcgttttttagtaatgctcaaagacatcgtaccaacaacagtgctatcgaatgtagagtatgttgttgaaactgttaacaaagtaggtggtgctgtagtaactgtagctttagctagtatacaattggcatatgaagctattgttaacattagaagatggtggaatggagagatttcaggcaagagatgttgtaaaaatattatagattcacttgctacaattggtggtagcgttggtggaggatttgctggtgtagctttgggagcacttggaggtccagttggcatgataatcggaggtattggtggaggaatgttgggcggagaattggccaagcgtctgtcgcaatggatgactgaaaaggtatttgatgttccaaaatctgaggcgctagaaaatgcttataatttctttaatttgcgcaatcatgcttccaatcatcagataaatacagcttacagacagaagtgtctagaataccatcctgataaaggaggttctgaggaaatgttccataaagtgcagatggaaatggcggttattaaagctgccaaaggagaattgtattcataataattagtttgtatttttgtacttagatttagattatataacatattttgtactatactattttatgtacacattatatttgtacagaaataaaaattaacg

SEQ ID NO: 433 - DNA, 658 bp, Diabrotica virgifera
  misc_feature (1)..(658): RNAi target sequence
  misc_feature (546)..(546): n can be any nucleotide
atgtttttaagatgggccagtgccagtcacacattgtgtttaagtttattttcgtgtttcttgctgggtacgaccgagtaacgaacaacctaggatatcacgccaaattcacaagtaacaagttccagtcctggagtaggagcagccctggcggcgttaggaagtctcggtggaatcttcggcaatcacttacaaatgttaggaagcttaccagctttccagagtccgcagagcctgcaacagctgcagcagctggcgatgctgcagcaggctagcggcaaccagatgaatccgcaggctcagtttttatttcaaaatcagggttttctacaagggttccctagaacaagtataccttctagacccccacatacaatgcaggtacaacaaatagcacaagctgcccagcaactacagcaactgcagaaagtacagcaaaacacaaaccaacacaataccagcattcctcaaaatacgacgttacctcatcaaacgcagaccacgcctccaaacaaccacaatatacctgccagcatgcttactccnagcacgcctagttctggtggacttacgccgcagcatcttaaaacaccctcaaggatactggaaccatctccagaagaaaccacagatttggaagaacttgaacagtttgcga

SEQ ID NO: 434 - DNA, 22 bp, Artificial Sequence
  primer
  misc_feature (1)..(22): forward primer
atgtttttaagatgggccagtg

SEQ ID NO: 435 - DNA, 22 bp, Artificial Sequence
  primer
  misc_feature (1)..(22): reverse primer
tcgcaaactgttcaagttcttc

SEQ ID NO: 436 - DNA, 698 bp, Diabrotica virgifera
  misc_feature (1)..(698): WCRW transcript ta21806.001_diavv
  misc_feature (566)..(566): n can be any nucleotide
ggagtgcatattgcccgcagatgtttttaagatgggccagtgccagtcacacattgtgtttaagtttattttcgtgtttcttgctgggtacgaccgagtaacgaacaacctaggatatcacgccaaattcacaagtaacaagttccagtcctggagtaggagcagccctggcggcgttaggaagtctcggtggaatcttcggcaatcacttacaaatgttaggaagcttaccagctttccagagtccgcagagcctgcaacagctgcagcagctggcgatgctgcagcaggctagcggcaaccagatgaatccgcaggctcagtttttatttcaaaatcagggttttctacaagggttccctagaacaagtataccttctagacccccacatacaatgcaggtacaacaaatagcacaagctgcccagcaactacagcaactgcagaaagtacagcaaaacacaaaccaacacaataccagcattcctcaaaatacgacgttacctcatcaaacgcagaccacgcctccaaacaaccacaatatacctgccagcatgcttactccnagcacgcctagttctggtggacttacgccgcagcatcttaaaacaccctcaaggatactggaaccatctccagaagaaaccacagatttggaagaacttgaacagtttgcgaagacgttcaaacagagaagg

SEQ ID NO: 437 - DNA, 647 bp, Diabrotica virgifera
  misc_feature (1)..(647): RNAi target sequence
  misc_feature (524)..(524): n can be any nucleotide
aatttcagccgtcatctgttgtgttggtgtgtctgtatttttgtgaatttcgcaaatatttttgattctaataacaaaaccttttgctaaattcagtgaatcatagtgctactttcttgttaaattcataagggaaagaagcatcaaccaacaaaaaattgtgaatgttctcctagagagatttcaactaacttcagagcaactctatatcattcaaggaaataaggagtttttattgactcctgaaatatttaatgtactagataagatccaagaaatacgcaatgattgtaaaatacttatgcagtctggtcttcaaacgttggctttagatattatggagcaaatgaccacatatcaggaggcagggttggaaaaattatatagatggacccaaagtcactgtagaaatgttgaaaaccctgaattaacagatctagttacacaatcaatggcaaggcttcaacacagacaagttttgtttaagtatgtaatcgatgaatactgcatatgtcgcagaagcnagataactgatgattttatcaacgctctaacacgaggagggccatctggaaatcctgctcctatagaaatgagagctcacgattctcagatctatgtcacagatatgctcgtttggttgaaca

SEQ ID NO: 438 - DNA, 22 bp, Artificial Sequence
  primer
  misc_feature (1)..(22): forward primer
aatttcagccgtcatctgttgt

SEQ ID NO: 439 - DNA, 22 bp, Artificial Sequence
  primer
  misc_feature (1)..(22): reverse primer
tgttcaaccaaacgagcatatc

SEQ ID NO: 440 - DNA, 727 bp, Diabrotica virgifera
  misc_feature (1)..(727): WCRW transcript ta21805.001_diavv
  misc_feature (540)..(540): n can be any nucleotide
ggcaatcgataccaaaaatttcagccgtcatctgttgtgttggtgtgtctgtatttttgtgaatttcgcaaatatttttgattctaataacaaaaccttttgctaaattcagtgaatcatagtgctactttcttgttaaattcataagggaaagaagcatcaaccaacaaaaaattgtgaatgttctcctagagagatttcaactaacttcagagcaactctatatcattcaaggaaataaggagtttttattgactcctgaaatatttaatgtactagataagatccaagaaatacgcaatgattgtaaaatacttatgcagtctggtcttcaaacgttggctttagatattatggagcaaatgaccacatatcaggaggcagggttggaaaaattatatagatggacccaaagtcactgtagaaatgttgaaaaccctgaattaacagatctagttacacaatcaatggcaaggcttcaacacagacaagttttgtttaagtatgtaatcgatgaatactgcatatgtcgcagaagcnagataactgatgattttatcaacgctctaacacgaggagggccatctggaaatcctgctcctatagaaatgagagctcacgattctcagatctatgtcacagatatgctcgtttggttgaacaaagcgattgctttggaaaagcagaatgttagtttattgttgaaattgtgcaataaagtagagct

SEQ ID NO: 441 - DNA, 711 bp, Diabrotica virgifera
  misc_feature (1)..(711): RNAi target sequence
gggggataagataataaatcgaacatacctgtttcgactctatgtggaatttgtcagtgcatggttatgcaatttagttaaaggttaaggataataattagtggaaaaaatgagttgcggttttgattcacaaagaatttatatgctaggtgaaaaatattcaggtctaaaagctagaggtgctctccaaaattatgaagaaattagaaagaaatatctgctgaacaatgcattattcgaagactcacaatttcaagtagaaaaagtagaactcggacaagagtgggacaatcataagaacaacattaagtggctccgaccccaggaaatggtttccgatccagtttttctagaagctcatgaagacaggttcgatattaaacaaggaactttgggcgattgctggtttttagcagctttggcaaacataacagacaataataaaataatgcagcgtattataccagacaatcaaagcttttctcaagattatgcaggagtatttcatttcaggttttggcaatatggtagatggatagacgtggttattgacgacaaattacctactatagatggtaaacttatctttactaagaccaaatttagcaacgtattttggacacctttattggaaaaagcatatgcaaaactgtatggatcttataaaaatattgaggggggctttatttctgaagctctggaagatttcac

SEQ ID NO: 442 - DNA, 24 bp, Artificial Sequence
  primer
  misc_feature (1)..(24): forward primer
gggggataagataataaatcgaac

SEQ ID NO: 443 - DNA, 23 bp, Artificial Sequence
  primer
  misc_feature (1)..(23): reverse primer
gtgaaatcttccagagcttcaga

SEQ ID NO: 444 - DNA, 2478 bp, Diabrotica virgifera
  misc_feature (1)..(2478): WCRW transcript ta05594.001_diavv
gggggataagataataaatcgaacatacctgtttcgactctatgtggaatttgtcagtgcatggttatgcaatttagttaaaggttaaggataataattagtggaaaaaatgagttgcggttttgattcacaaaaaatttatatgctaggtgaaaaatattcaggtctaaaagctagaggtgctctccaaaattatgaagaaattagaaagaaatatctgctgaacaatgcattattcgaagactcacaatttcaagtagaaaaagtagaactcggacaagagtgggacaatcataagaacaacattaagtggctccgaccccaggaaatggtttccgatccagtttttctagaagctcatgaagacaggttcgatattaaacaaggaactttgggcgattgctggtttttagcagctttggcaaacataacagacaataataaaataatgcagcgtattataccagacaatcaaagcttttctcaagattatgcaggagtatttcatttcaggttttggcaatatggtagatggatagacgtggttattgacgacaaattacctactatagatggtaaacttatctttactaagaccaaatttagcaacgtattttggacacctttattggaaaaagcatatgcaaaactgtatggatcttataaaaatattgaggggggctttatttctgaagctctggaagatttcaccggtggactaaatgaaagataccttgatttagcaaacatttcaaaacatgaggaccttttcaaaatgatgctaatttcatttatgagaaaatcgtacatgggctgtggtatcctggattctggtgaagttgaaggagaaagaaaagatggactttattcaagtcatgcttacagtataaacaatgtagtggaggttacctcaaaagctgaaaaagtctataagttgcttaggcttaggaatccatggggcacgggtgagtggacaggcgactggagtgaccattcaaaaacctgggaccttcttccagacgaaactaaaaataagttattagtgataaaggatgatggagaattttggatgcaacacgaggatttcattaaagattataatttgttagaattttgtcaccctaatcccgactcactagaatatgaagaagatgaatcacataaatggaacatttttatgcttgatggcagttgggttgcaaaaattagtaatggaggtcagccacatagtacaagtttttggcataactcgcaatatttgttaaaaataaatgatagtagtaatgctatacacagagtagtaattggattaatgcagaagaatagaagactgtacaatcttcccaagattcctataggatttgctgtgtatgaactaaaatccgtttctggacgtttaacgcataattttttctcctcaattaaacctatatatattagagaaccagagaacaatacacaggttacgggacacatagatttaccaaaaggatcctactgcataataccatttacagatgaaccacaagcaagctgtgaatttcttttaagggtttactctactgttacatttgatgttaatgaacacgaagtagatgttcgattgatagatccaacagtaccattaggagggttacgtgcacctgtagacgcagtagatggtgcggctgccgataaaggaataaaacatgtattcgagaactatgctgataaagaattagaaataggttggaaggaactagtatctatactagaacttcttttctcaacagaacaacacatattttcaaaggaactgtgtcgaagtatggttgcattagcggatactgacctttcaggaaaactcaattttcaggaattctatgagctttgggaacaaattggagaattaaaaggcattttcaaaaattttgattcagatagttccaacggaatgtcagtgcgtgaacttagacaggctcttagagtagctaatttccaacttagcaataaaattttatccctaattggactgagatacgcaaacgaaaaagatgagttggaattagaagactttttgcattgttgcgttaaattaaaattaatgatagatatttacaactccaaaaagaaaagagaatatggcttggaggaatggttacttgaaacaatgtatgcttaaggtgcaagaatatttttgttatattttttattggtttgataaaataaaatgaatattccagtatataaatatatgagttgattgaaatatccataatatttcaatcaaccatattttataagtatttaacatgtctgtaaaaaaaagaaatctaatagaacttttaacgttattattaatactgatgatagatggcatcgcatgtacgtgtataaaataaaaattgaatactgcaaatgaaagagaatatacataatattatgtacatagtttggaaatagtatatttgtttgaaacgatttatactaacagtaatc

SEQ ID NO: 445 - DNA, 579 bp, Diabrotica virgifera
  misc_feature (1)..(579): RNAi target sequence
cgccatttttgttttcgtagttggaggcgatgtagggaactcaatcgattcatacaaaacttttactggaatgaagcatttcagcggaaacctcatgtttctgtcctgagccgtttagaagttgtacgtagttgaaatgggggaaaatataagtggacacccggtataatatgcagatgaatgtagaaaaaacacaatatttatgcctaggtgaagattcaactgatatgatattggacaatataatcagaaaataactagttgtggtaaatataagtatttgggaattaatttcagcaaagaagatgcggacgatgcagaaattaagagcacagtcaataaagaaagaacgataattagagatataattaaatcattgaacggagttttgtggagtaccaagatagagaaacaaagaaaaatgagaatatacaacaccatgattaagagcacattggtatagggatccgaaacatggagagtaaaggaacaccaaaaaagtaaaatagaagctaccgagatggacgccctaagaagagcaagtagaacatcgagattggaccgggttagaaatgagta

SEQ ID NO: 446 - DNA, 22 bp, Artificial Sequence
  primer
  misc_feature (1)..(22): forward primer
cgccatttttgttttcgtagtt

SEQ ID NO: 447 - DNA, 22 bp, Artificial Sequence
  primer
  misc_feature (1)..(22): reverse primer
tactcatttctaacccggtcca

SEQ ID NO: 448 - DNA, 628 bp, Diabrotica virgifera
  misc_feature (1)..(628): WCRW transcript ta21896.001_diavv
gtaaattcattatttgctttacttactcatttctaacccggtccaatctcgatgttctacttgctcttcttagggcgtccatctcggtagcttctattttacttttttggtgttcctttactctccatgtttcggatccctataccaatgtgctcttaatcatggtgttgtatattctcatttttctttgtttctctatcttggtactccacaaaactccgttcaatgatttaattatatctctaattatcgttctttctttattgactgtgctcttaatttctgcatcgtccgcatcttctttgctgaaattaattcccaaatacttatatttaccacaactagttattttctgattatattgtccaatatcatatcagttgaatcttcacctaggcataaatattgtgttttttctacattcatctgcatattataccgggtgtccacttatattttcccccatttcaactacgtacaacttctaaacggctcaggacagaaacatgaggtttccgctgaaatgcttcattccagtaaaagttttgtatgaatcgattgagttccctacatcgcctccaactacgaaaacaaaaatggcggatttttgaaaaaaactctgttgccc

SEQ ID NO: 449 - DNA, 539 bp, Diabrotica virgifera
  misc_feature (1)..(539): RNAi target sequence
ctatatgagacgaggccagacaccatatggaggagtacatcttgctgatggcgttgtagctgatggtttatgggacgtttacaacaaattccatatgggtaactgcacagaaaacacagcaaagaagctgaacatctccagggctgaacaggatgagtatgctatcaacagttacaagaaaagtgccgaagcatacaaaaacaatgcttttgcttctgaattagtatcagttaatgtaccacaaaggaaaggacaaccagatttggtggtttcagtagatgaagagtacaaaagggttaactttgaaaagtttaacaaactgccaacggttttccaaaaggaaaacggcacagtaacagctggaaacgcttcaactttaaacgacggtgcagctgctttgatcttaaccactgccgaaaatgccaagaggttaaacgctgaacctctagctcgagttgttggttaccaagacggtgaatgtgacccaatcgatttcccaatagcccctgccgtagctattccaaaattgctcgaaaaga

SEQ ID NO: 450 - DNA, 22 bp, Artificial Sequence
  primer
  misc_feature (1)..(22): forward primer
ctatatgagacgaggccagaca

SEQ ID NO: 451 - DNA, 22 bp, Artificial Sequence
  primer
  misc_feature (1)..(22): reverse primer
tcttttcgagcaattttggaat

SEQ ID NO: 452 - DNA, 1541 bp, Diabrotica virgifera
  misc_feature (1)..(1541): WCRW transcript ta05758.001_diavv
ttattgtaaaataagtgttgcagttatttaaaatcgtatgtttataattttttcatattagttgaacaagggtagggtcaaagtttaatccaaagtggtggggaaggagaatactttatcacttatttgttctggaaatattttgagaattgtcgttcacttattttagaagataggcttaaaaatgatcatgtcaaagccaactaaggttattcaaatgagcagaagattctacagctctggctctaaaaacgatattgttattatttctgcagttcgaactccaatgggtacgtttctgggacccttagcacctttatcagctcccagattgggagcagttgccatacaagcagctgttgaacgagctggaattcccaaagaagaagtcaaagaagtcttcatgggccatgtttgtcaaggaggcgctggacaggccccagccagacaggctacagtttttgcaggtcttccaaagtcaacaatatgcacaactgtcaacaaagtatgctcatcaggcatgaaatctgtaatgtttgcaacacagagcttgctactcggcgaccaagacgtcatactagccgggggaatggaatccatgtcgaatgtaccatactatatgagacgaggccagacaccatatggaggagtacatcttgctgatggcgttgtagctgatggtttatgggacgtttacaacaaattccatatgggtaactgcgcagaaaacacagcaaagaagctgaacatctccagggctgaacaggatgagtatgctatcaacagttacaagaaaagtgccgaagcatacaaaaacaatgcttttgcttctgaattagtatcagttaatgtaccacaaaggaaaggacaaccagatttggtggtttcagtagatgaagagtacaaaagggttaactttgaaaagtttaacaaactgccaacggttttccaaaaggaaaacggcacagtaacagctggaaacgcttcaactttaaacgacggtgcagctgctttgatcttaaccactgccgaaaatgccaagaggttaaacgctaaacctctagctcgagttgttggttaccaagacggtgaatgtgacccaatcgatttcccaatagcccctgccgtagctattccaaaattgctcgaaaagaccggagtcagcaaagacgaggttgccatgtgggaaatcaatgaagcgttcagcgttgttgtcttagctaaccaaaaaatccttgggctcaatccagacaaagttaacatccacggaggtgctgtcagtttgggccatcccatcggtatgtctggtgccagacttatcactcatctcgttcactctctcaaggctgaagagaaaggagtcggtgctatctgtaatggaggaggaggagcttcttccatgatgatcgagaaattgtaagtggatcttggatctcagaactgaatcttaggtttaagtgcaaaaatcatatattttttaagaattttagatgtgcatttatgaactgatattataattttataaactattttaaatcctg

SEQ ID NO: 453 - DNA, 603 bp, Diabrotica virgifera
  misc_feature (1)..(603): RNAi target sequence
ggggtgtgtatctctgtgctataagtttagtgtaaatactgtaaccttgaaaattttgaagtaacctgtgttttctagaaaattaaggaaacatcaatgaaactttggatcccaagttgaccttgagcgattatcagatcaccgaaatttacgtggtcggaaaaggaacacacagtcttactcaagcattttccagtagcgacattatggcattaagaaaagaagaagaaaggaaacaaatgcataacaagactggaggaggtgtattcaacttaatttttaggagaggaaaatcgagtatgggttcgggttcaatctccagcgatacacgttctatttcgccgactcacagcgacgattcccgctcagttacaccacctgcagtcattcagcaacctattctgccaccgccgaagcaagatccgcctcccgaacgaccgaaacctccacaacgtaaacggagacccgctccgagacctccgcagctaacccctccacagcaggagatacctaaggaggaaactgccattgatgctgaagattctaaagaatctcgtcgaaattcggaagaaaaaccagcgagcaccgtttcagaagttagtg

SEQ ID NO: 454 - DNA, 22 bp, Artificial Sequence
  primer
  misc_feature (1)..(22)
ggggtgtgtatctctgtgctat

SEQ ID NO: 455 - DNA, 22 bp, Artificial Sequence
  primer
  misc_feature (1)..(22): reverse primer
cactaacttctgaaacggtgct

SEQ ID NO: 456 - DNA, 736 bp, Diabrotica virgifera
  misc_feature (1)..(736): WCRW transcript ta14242.001_diavv
  misc_feature (627)..(627): n can be any nucleotide
  misc_feature (629)..(629): n can be any nucleotide
  misc_feature (630)..(630): n can be any nucleotide
  misc_feature (631)..(631): n can be any nucleotide
ggtgtgtatctctgtgctataagtttagtgtaaatactgtaaccttgaaaattttgaagtaacctgtgttttctagaaaattaaggaaacatcaatgaaactttggatcccaagttgaccttgagcgattatcagatcaccgaaatttacgtggtcggaaaaggaacacacagtcttactcaagcattttccagtagcgacattatggcattaagaaaagaagaagaaaggaaacaaatgcataacaagactggaggaggtgtattcaacttaatttttaggagaggaaaatcgagtatgggttcgggttcaatctccagcgatacacgttctatttcgccgactcacagcgacgattcccgctcagttacaccacctgcagtcattcagcaacctattctgccaccgccgaagcaagatccgcctcccgaacgaccgaaacctccacaacgtaaacggagacccgctccgagacctccgcagctaacccctccacagcaggagatacctaaggaggaaactgccattgatgctgaagattctaaagaatctcgtcgaaattcggaagaaaaaccagcgagcaccgtttcagaagctagtgagttgcagtcgaaaaaaatcgaaacngnnntagtcatctgtcattccggaaatagttcagatagttcaggataccatgaagcatcagttttaagtgacaactgcaacacgtcgttgccacgaaggccaaaatcgg

SEQ ID NO: 457 - DNA, 519 bp, Diabrotica virgifera
  misc_feature (1)..(519): RNAi target sequence
cctcgttggtggagtagtcaattcagcattgtacaatgttgatggaggtcacagggcagttattttcgacaggttcgccggtattaagaaacaagttataggcgaaggtacacatttctttataccttgggtacagaaacctattatctttgatgtacggtctcgccctagaaatatcccggtaataacaggtagcaaagatctgcaaaacgtaaatatcacactccgtattctcttcagaccagttccagacgaattaccaaagatctacacaattttaggccaggattatgaagaaagagttttaccatcaatcactaatgaagtcctaaaagctgtggtggcacaattcgatgccagtgaactgattactcagagagatgtagtttcccaaaaagtcagtgaagatttaactgaaagagctactcaatttggtgttatccttgatgatatatcattaacccacttaacctttggtagggaattcacacaagctgtagaattgaaacaagttgccca

SEQ ID NO: 458 - DNA, 22 bp, Artificial Sequence
  primer
  misc_feature (1)..(22): forward primer
cctcgttggtggagtagtcaat

SEQ ID NO: 459 - DNA, 22 bp, Artificial Sequence
  primer
  misc_feature (1)..(22): reverse primer
tgggcaacttgtttcaattcta

SEQ ID NO: 460 - DNA, 1170 bp, Diabrotica virgifera
  misc_feature (1)..(1170): WCRW transcript ta06694.001_diavv
cacaaatctaaatcggcattttgatcatcaattttgtggttttttattataaattcagctgttaggttgaaaaatatttcagtctaaaaattacgttataaaagacatcgaaatcttcgatcgattataaccataaaagcattttagtttgtttgcatttttacataacttaacctctcatagtgaacttcacatgtaaagatgtctgcagctcaaattttcaacagaatcggccaagttggtctaggaatagccctcgttggtggagtagtcaattcagcattgtacaatgttgatggaggtcacagggcagttattttcgacaggttcgccggtattaagaaacaagttataggcgaaggtacacatttctttataccttgggtacagaaacctattatctttgatgtacggtctcgccctagaaatatcccagtaataacaggtagcaaagatctgcaaaacgtaaatatcacactccgtattctcttcagaccagttccagacgaattaccaaagatctacacaattttaggccaggattatgaagaaagagttttaccatcaatcactaatgaagtcctaaaagctgtggtggcacaattcgatgccagtgaactgattactcagagagatgtagtttcccaaaaagtcagtgaagatttaactgaaagagctactcaatttggtgttatccttgatgatatatcattaacccacttaacctttggtagggaattcacacaagctgtagaattgaaacaagttgcccaacaggaagctgagaaagctaggtttttggtagaaaaagctgaacagacaaagaaagcaactgtaatctcagcggagggtgatgcccaagctgctgtgcttcttgccaaggcttttggtgatgctggagaaggtttagtagaactgagacgtatagaagcagctgaagatatcgcataccaactatcaaggtcaaggcaggtttcctacttgcctggaggacaaaatttgttgttgaatgtgccaacacctggtaattagatggatagagtaacaaacaaaattggagctagttgattatttggctctatgaatgagagagttgcccatttagcttttatggttctattattttttataaaagtatgttaataaattgttgataaattttaaaaaaaa

SEQ ID NO: 461 - DNA, 602 bp, Diabrotica virgifera
  misc_feature (1)..(602): RNAi target sequence
gggaagactcccaagatatggtcgacgagtccacagatcacgtttccagaacgaacgaaaaatcgacgatattcgaccaggttaaacagtttttaaagaataaccatcaaattcctggcatggcagatttagaagctaagcaagaagaagttttaaaacagcttgcagacctcaagaaacaaattctctcaattaaattggatttgaaaattaatgcaaactcagtaggaacaaacaagacctgtccaagtatttcagcagaaaagctgaatgctcttcctgatcttgttgtgaatgcaagtccaacaaatccgccatattcattactgataattcaaaagctactacgtgacattgtcgaattgaaggttacatcccatatacactcctcagttccaacattgaatgaaaatgccaaacagctgggtgactcattggcaagttacgtaccgaaacgtggtgtaccaagtgttaacattaaattgatatggaaaaatgtgggcatcgacacagaactcatagtatcacacgttccaatttttggagaagtcaacttattacggtatctaaccagggtaatcagttccccactcagatacagt

SEQ ID NO: 462 - DNA, 20 bp, Artificial Sequence
  primer
  misc_feature (1)..(20): forward primer
gaagactcccaagatatggt

SEQ ID NO: 463 - DNA, 23 bp, Artificial Sequence
  primer
  misc_feature (1)..(23): reverse primer
actgtatctgagtggggaactga

SEQ ID NO: 464 - DNA, 1170 bp, Diabrotica virgifera
  misc_feature (1)..(1170): WCRW transcript ta07588.001_diavv
taattatgtaattaggctgagtaaatatgaagttttgcctcttttaaggataacatacaatatcatctggacccctttttaagaacgccagtgaaaaattatttagcagacgaagactgattaccaaaaaaattatatatcgaatttctaaagttaattgtaacattttagcgaagaaaaatgaatgggccgataaaaatgtatcgaacacgacaaataattcaccacgaccaaaagattgacaagccgaagtgtatgtatgctttaaaaaatatctactcaaaagactcccaagatatggtcgacgagtccacagatcacgtttccagaacgaacgaaaaatcgacgatattcgaccaggttaaacagtttttaaagaataaccatcaaattcctggcatggcagatttagaagctaagcaagaagaagttttaaaacagcttgcagacctcaagaaacaaattctctcaattaaattggatttgaaaattaatgcaaactcagtaggaacaaacaagacctgtccaagtatttcagcagaaaagctgaatgctcttcctgatcttgttgtgaatgcaagtccaacaaatccgccatattcattactgataattcaaaagctactacatgacattgtcgaattgaaggttacatcccatatacactcctcagttccaacattgaatgaaaatgccaaacagctgggtgactcattggcaagttacgtaccgaaacgtggtgtaccaagtgttaacattaaattgatatggaaaaatgtgggcatcgacacagaactcatagtatcacacgttccaatttttggagaagtcaacttattacggtatctaaccagggtaatcagttccccactcagatacagttctgactctgatagtgtagaaatcgattcgatattagacacttgttatcttcttctgagagctaaaacgaaaactgaaaaggcaggacatattgccacattaaataaatccttaggaaaatcccaatggttagcaggtagaagtaggcatagtctgggggatctagccgcatactctgcccttaaacaggttacaagtggtagtgaaattaatgcaaatatgacgaagtggtatcagcggtgtgaaactgttgtataaaattatttttgttataaatataagctttaa

SEQ ID NO: 465 - DNA, 508 bp, Diabrotica virgifera
  misc_feature (1)..(508): RNAi target sequence
caaaacgaatgtgttgagtgtgtttttgtggatatggttctggttaataaggcgcttgatttatctcatagataacataatttttgttaaaactggtataactgctgattattattattctctttgtcaacaagagtgttacgtatagtgttatgtatagaacattcacgaagggttgcttcagcttccggtcagaccatgcccgtcttacccacgacccacgatgaggtagcaagacatgatttcgacaccgtcaccatcgattcatatggaatgagccccttggccttgcagaaaattagggagcagatggctttgagcctggagcgaaccaagcagttggaggaccagatcaagagcatgcacaaattggaggaggaggtcaacttcctgaaggatgaaaattgtaggttacgaaacagtttgaaatcagaaaacggaaaaaaccaagccacaataaatgacaattatatcgaacattacaaacgacagaggtctcaatcattca

SEQ ID NO: 466 - DNA, 22 bp, Artificial Sequence
  primer
  misc_feature (1)..(22): forward primer
caaaacgaatgtgttgagtgtg

SEQ ID NO: 467 - DNA, 22 bp, Artificial Sequence
  primer
  misc_feature (1)..(22): reverse primer
tgaatgattgagacctctgtcg

SEQ ID NO: 468 - DNA, 3569 bp, Diabrotica virgifera
  misc_feature (1)..(3569): WCRW transcript ta01520.001_diavv
ggggaactgtgttttgttcaacaaaaaataagtacctgtcacaaagtacatatatggagaacataaacaaaacgaatgtgttgagtgtgtttttgtggatatggttctggttaataaggcgcttgatttatctcatagataacataatttttgttaaaactggtataactgctgattattattattctctttgtcaacaagagtgttacgtatagtgttatgtatagaacattcacgaagggttgcttcagcttccggtcagaccatgcccgtcttacccacgacccacgatgaggtagcaagacatgatttcgacaccgtcaccatcgattcatatggaatgagccccttggccttgcagaaaattagggagcagatggctttgagcctggagcgaaccaagcagttggaggaccagatcaagagcatgcacaaattggaggaggaggtcaacttcctgaaggatgaaaattgtaggttacgaaacagtttgaaatcagaaaacggaaaaaaccaagccacaataaatgacaattatatcgaacattacaaacgacagaggtctcaatcattcacaaacgtaaacaatttggagatctcaatgcgaaaagaatcatccccaccacctccaccaccacgaaaagattttggagtgatgtgtggggtgttgacgaggaacataggagtaggcaatcagacacctaacacaaagaatgtttctacggctacttttgaaaatgaattcgctgataagtggctgccagaaaaggtcaaatttcttaacaatcagaacttgaagtcatctagtaaaatcacgatatcaaaagaaacgcaaaccctaggacaaaagtcaagctcagataaaggtgtccaattccaaacaaagagtcctacagtgcctaagttcagcacctacacgcaaactacaacaactaaaaaacaactagtggataaagggatcttagcaactgtcaaagtatctcatatttctgtccagaaatgtgttgaatgttactctattggcacttcagatgacacagtaaatgatatcatttgcgaaaaatgcaatgctacaaaaaagatctatagcaataggtcctgaatctaatgaagatagccatacgtcgcctatatccttagcgtcccttaacttaagaagcaaatcgttcaatatgggcgaagatcgacttaaccttaccactagaacccgttccatagcatcacagtacgaatctagtagcatcagcagagcttgtcaggcgaaacttaagaaggattcttctacgaaatcttgccaagctgaaacgaaaatgactgacaaaaacacccagtacgtaaattacactgtctcaaggcataccgacactcaagactttataacaccaaagaaaaacgtcagttgcgaagcagttgaacaaaaaccggaaaccattgaggtggcttgtaataccgcgactgatttgctgacctgcgtcaaatgtgaaaaagaaaaagaaaaggaggcgctgaagaaagacggaggcagccccactccatctagaataccgcgaccacaaattccgactactcccgtagaaaatagaaagtttaggagacaagatacttatactaaagtatattcaccaactgagaaagctacatcacctactagtccaagattgtctggtttagatctatcacctaaagtcatatcaaacgattcaaatcccttagataaagttaaaagtaacctcaaactagtagaaccaataccacatgctcaaaatggtgtcaatttcacagcgcctattaccaaagttcaaattcaagaaattacactgccaacttcagaatctgttttccaacccattacacaaaatcaaaataggaaaaaagtcatgccaagtaaggaaatgcagggtgcaatgaaagtcctgaacgatcatcttatgaagaacccttccaaaaacatcaagaacccaactgctgaaaatattattcaaacagaatggttcaaaatctcgagctcagtaacagccaatccattggaagtggaggattacctggatgctttcgaagacgtgtccagcttgttactggaatacatagtaaacatgagtgattatagtgggaacacagccatgcactatgctgtttcccatggcaactttgatgtcgtatccattttgttagattctaaagtttgtgatatcaataaacaaaataaggctggatatacaagtgttatgttagtttctttggcggaagttcggtcccaaacacatgccaacgttgtccgaagactgttccagttagctgatgtgaatattagagcgaaagagcatggtcaaacagcactgatgttagcagtaagccacaataggttgaacatggtcaagatgttgttggaagcaggtgcagatataaatattcaggacgaagatggcagtacggcgttaatgtgtggtgctgaacacggccatatcgaaatagttaaacatttcctttcccaacctgactgcaattcgaccattatggatatggatggcagcacagctctagcaatagctatggaagccggtcaccgacacatcggagtcctgctctacgctcatgagaggaatagccaaaagtctcataacgtgaagttaaaaaaagcaaaatcaacaaatagtccgaaaaccccttcctcaccactggctgcaagaagtagccatcgtgccttaacagatacgaaacctaaatagtactaacccatttctaactgtgttttaacttaagaaggtaatgcgtgttgtttcgctgttaacgattctgttaaccatcgtgatgtattcatatacgatggttctagatttttggcatgtaaaatgcatgtttattcagtgtcatcaagatagggaacccaaagttattcatccggtccaaacaactctatctagatgaacatattcttatgtataatggaaaagaatcttagtcgatatatggcctggcgcaaatttgacccaaccgagacacaatacactccggggccacggatgacccttgcatttatttttctactgcagcgcatattgaacccaaccgtgggctgtcgccgtggccagttgctaaaatgtagtgatgttgattatagttattttcaagtatctatgtattcgttacttttgtgtaaagtaataatttacattattcgttacattgattactatgaatacttcgaatatttatgtatttcactaacagtaatcatatagaaaatcggaattcctcagtattttgaatataccttacaatattgtaacacaagtgagcgcttccaacaaatttaaacatattttaagtgatatgcgttactattgataatacaaaaataaaaaccgtgaatacataaaaacaatacaatatataataaaacaatgaaatacataaaaacaatgaaatacatgtaaaattaaagttgttgattatagtgtagatacattatcatttccacatatttttagtcaatctaaagctattttttatctaagactaataatatacaaccgcgtaaccaggatgatcctaagggggggggggttacg

SEQ ID NO: 469 - DNA, 525 bp, Diabrotica virgifera
  misc_feature (1)..(525): RNAi target sequence
gggaaccatctgataccattgagaatgtcaaagctaagatccaagataaggaaggtatcccaccagaccagcaaagattgatctttgcaggaaaacagctagaagatggtagaaccttgtctgactataacatccagaaagagtccactcttcacttggtactgagattgagaggaggtatgcagatcttcgtcaagacactaactggaaagactatcactttggaagtagaaccatctgatactattgagaatgtgaaagctaagatccaagataaggaaggtatcccaccagaccagcaaagattgatctttgcagggaaacagctagaagatggtagaaccttgtctgactataacatccagaaagagtccactcttcacttggtacttcgattgagaggaggtatgcagatcttcgtcaagacactaactggaaagactatcactttggaagtagaaccatctgataccattgagaatgtgaaagccaagatccaagataaggaaggtatcccaccagatc

SEQ ID NO: 470 - DNA, 20 bp, Artificial Sequence
  primer
  misc_feature (1)..(20): forward primer
gaaccatctgataccattga

SEQ ID NO: 471 - DNA, 22 bp, Artificial Sequence
  primer
  misc_feature (1)..(22): reverse primer
gatctggtgggataccttcctt

SEQ ID NO: 472 - DNA, 703 bp, Diabrotica virgifera
  misc_feature (1)..(703): WCRW transcript ta21603.001_diavv
gcacgaggcttggtacttagattgagaggaggtatgcagatttttgtcaagacattgactggtaaaactatcacattagaaggggaaccatctgataccattgagaatgtcaaagctaagatccaagataaggaaggtatcccaccagaccagcaaagattgatatttgcaggaaaacagctagaagatggtagaaccttgtctgactataacatccagaaagagtccactcttcacttggtactgagattgagaggaggtatgcagatcttcgtcaagacactaactggaaagaccatcaccttagaagtagaaccatcagataccattgagaatgtgaaagctaagatccaagataaggaaggtatcccaccagaccagcaaagattgatctttgcagggaaacagctagaagatggtagaaccttgtctgactataacatccagaaagagtccactcttcacttggtacttcgattgagaggaggtatgcagatcttcgtcaagacactaactggaaagactatcactttggaagtagaaccatctgataccattgagaatgtgaaagccaagatccaagataaggaaggtatcccaccagatcagcaaagattgatctttgcaggtaaacaattggaagatggaagaaccttatctgattataacatccagaaagagtccactcttcatttggtactta

SEQ ID NO: 473 - DNA, 653 bp, Diabrotica virgifera
  misc_feature (1)..(653): RNAi target sequence
  misc_feature (623)..(623): n can be any nucleotide
gatcagctaagaggctgacaccacgccattttgctttgagaacacgtttttggattttatatacagtaaattagtctattaatttatcaaaatgtctggagaagaaacatctgccgatagaaatgttgagatatggaaaataaagaaacttataaaaagtttggaactagcaagagggaatggaacaagtatgatctcacttataattcctccaaaagatcaaatatctagagtaagcaaaatgttagctgatgaatttggtacagcctctaatattaagtctcgagtaaatagactttcagttcttggtgctatcacatcagtccagcaccgtttaaaactatataccaaggtccctcctaatggattagtcatttactgtggaactattgtaactgatgaaggaaaggaaaagaaagtaaacatagactttgaaccattcaaaccaattaatacctcattgtatttatgtgacaataagttccatacagaagccctgacagcattattggcagatgataataaatttggttttatagttatggatggtaatggtgcattattcggtacactacaaggaaacacaagggaggtacttcacaagtttactgtagatttacccnagaaacacggtagaggaggtcagtctgcac

SEQ ID NO: 474 - DNA, 22 bp, Artificial Sequence
  primer
  misc_feature (1)..(22): forward primer
gatcagctaagaggctgacacc

SEQ ID NO: 475 - DNA, 22 bp, Artificial Sequence
  primer
  misc_feature (1)..(22): reverse primer
gtgcagactgacctcctctacc

SEQ ID NO: 476 - DNA, 2829 bp, Diabrotica virgifera
  misc_feature (1)..(2829): WCRW transcript ta00933.001_diavv
aaacaatttagggtggatttgaaattaaatttaatcaaaatttggtggacaaaataaaatcccaattttcaaatttttgttttttatgacagatatctgaactgaattatcaattggatatgccaaatcacctaaacagaatattgttctttacctgaatttacagttaaggccgtgaatatccagttaaaaccagttggtttcagttaataactagtgaaaagtgactttcctggatcctcttgttgatcagctaagaggctgacaccacgccattttgctttgagaacacgtttttggattttatatacagtaaattagtctattaatttatcaaaatgtctggagaagaaacatctgccgatagaaatgttgagatatggaaaataaagaaacttataaaaagtttggaactagcaagagggaatggaacaagtatgatctcacttataattcctccaaaagatcaaatatctagagtaagcaaaatgttagctgatgaatttggtacagcctctaatattaagtctcgagtaaatagactttcagttcttggtgctatcacatcagtccagcaccgtttaaaactatataccaaggtccctcctaatggattagtcatttactgtggaactattgtaactgatgaaggaaaggaaaagaaagtaaacatagactttgaaccattcaaaccaattaatacctcattgtatttatgtgacaataagttccatacagaagccctgacagcattattggcagatgataataaatttggttttatagttatggatggtaatggtgcattattcggtacactacaaggaaacacaagggaggtacttcacaagtttactgtagatttacccaagaaacacggtagaggaggtcagtctgcacttcgttttgcccgtctgagaatggaaaaacgtcataactatgttcgaaaagtagcagaagtagctacgcaattatttataacaaatgacaaacctaacatagctggactcatcttggcgggtagtgccgattttaagactgaacttagtcaatctgatatgtttgatccaaggttacaagctaaagtaatcaaactagtagatgtctcgtatggtggtgagaatggatttaatcaagccatcgaattagcagctgaatcacttcaaaatgtaaagtttattcaagaaaagaaactgataggcagatatttcgatgaaattagccaagatacggggaaatactgttttggagttgaagatactcttaggggcttggaattaggtgctgtagaaacactaatctgttgggagaatttagatattcagcgatatgtattgaaaaaccatgctacaggttcggaaactatactgcatttaactcctgaacaagaaaaagataaatcacatttttcggataaagagactggtgtagaattggaattggtcgagtgtcaacctcttcttgaatggttggcgaataattacaagaacttcggtgccactttagaaattattacagacaaatctcaagagggctcccaatttgttcgagggtttggtggaattggaggtttgctccggtacaaagtagacttccaaagtttacaactagacgatatggataacggcgaagaatttgatctagatgattattaaatgtagagacaaatttgtagaaattttcatttaaaacaatgtgggcccgttatgtaataaacacgtgtaaaaagtaaatgatggcaatatactaatttatcctaaaggagtataatatgatgtgcttttttgtaatattatttccaaatttatgctttcacaaacttgaaagtttattccatgaaaagttttaattatatcattaaattaataagtattattgattaattttatttattgattaatctatgttagtaaaatgtacaaagcacaaagataaagatagttaggataaccctttacaccaactgaaagtatagaaatttccggattgtttggtacggcaacaaacaaattcacacgaaattccaaatttgataatgtctactacagttgaagatgacaatagataattccagaccacgacctatacgctcagaaaacaatgtaccattacaaaacggctgcgaaagcctacattcatacttgattcgtatacatactgtccatgggcgctcatacccatgggcagggtagggggcgtggccccctggcttttcgggtgctttaaactatatgtcgttatccaaagtatacatacctaaggtaatgtgcaacatcttcacgtctgccctccccctaaaaatttttatatgggcgcccgtgatactgtcctaagttacacatccatttttgtccacgtgtgtgaccaggagcgccattaccaacggttcccaagactgagagtcatagcttactcggagcagtagggatttaaagaagaaaaaacgagctatgtacttgtcagtgtgtcggatcacacacagatcggtttagtagtttgtataaattatataaaataaaaatgtagatttggaaataatattacaataatatcggagtgatcatgtgttttgtataaattatattgtctcaaaaaatgtttaccgatatttattatttaattgttaaaattatgtatgtatattgcaagtgtttataattaatagtgaaaaagaccagtatttctacagtggcttgtttttttcattggtttttatatatttagaacagaatattttttgtatttactttttttgttaacgaggtaataaatcaggtttggaaattcttcattctattttagtttgtaaccattggcatttttgttttt

SEQ ID NO: 477 - DNA, 577 bp, Diabrotica virgifera
  misc_feature (1)..(577): RNAi target sequence
ctgactctgttcattggggagtggttgaaaggggtgttttttggagttattccattatttgaaggagtgataaagaagatcttggaagccaccatagacttaattcacatagaaccagcatactttctgatcaccaagaagaaatgactgagtattggttgatatctgccccaggggataagacctgtcaacagacatgggacacgatgaataatatgacaagtaaacagaataatttgtcaaccaactacaagtttcaaatcccggacttgaaagttggtactctggatcagttagtaggactttctgatgatctgggcaagcttgatgggttcgtggagcaggttaccaggaaggtagctcagtaccttggagaagtacttgaagaacagagggacaagtggtcagaaaacctgcaggccaataacagcgatttgcccacttatttaacccgatttacttgggacatcgccaaatatcccatcaagcaatcgctccgtaacatcgccgatataatcagcaaacaagttggccaaattgacgctgatctgaagaccaaatcgtctgcgtacaataa

SEQ ID NO: 478 - DNA, 22 bp, Artificial Sequence
  primer
  misc_feature (1)..(22): forward primer
ctgactctgttcattggggagt

SEQ ID NO: 479 - DNA, 22 bp, Artificial Sequence
  primer
  misc_feature (1)..(22): reverse primer
ttattgtacgcagacgatttgg

SEQ ID NO: 480 - DNA, 2409 bp, Diabrotica virgifera
  misc_feature (1)..(2409): WCRW transcript ta01215.004_diavv
ggtgaaacttcaataacgatcagctgggctgactctgttcattggggagtggttgaaaggggtgttttttggagttattccattatttgaaggagtgataaagaagatcttggaagccaccatagacttaattcacatagaaccagcatactttctgatcaccaagaagaaatgactgagtattggttgatatctgccccaggggataagacctgtcaacagacatgggacacgatgaataatatgacaagtaaacagaataatttgtcaaccaactacaagtttcaaatcccggacttgaaagttggtactctggatcagttagtaggactttctgatgatctgggcaagcttgatgggttcgtggagcaggttaccaggaaggtagctcagtaccttggagaagtacttgaagaacagagggacaagtggtcagaaaacctgcaggccaataacagcgatttgcccacttatttaacccgatttacttgggacatcgccaaatatcccatcaagcaatcgctccgtaacatcgccgatataatcagcaaacaagttggccaaattgacgctgatctgaagaccaaatcgtctgcgtacaataacttgaaaggaagtcttcagaatttggagaagaaacagacaggaagtttactaacaagaaacttggcagatttggtgaaaaaggaacattttattttggattctgaatatttgcagacattgttggttattgttccaaaagcccaattcaacgaatggaatgcgacatacgaaaagattaccgacatgatagtccctcgttcttcacaactgattaaacaggataacgaatacggtctatatactgtatccctattcaaaaaggtcgtcgaagaattcaagttacacgctagagaaaagaagttcatcgttcgtgatttcatatataacgaagaggaactggcagctggaaagaacgagataaccaaactcgtcaccgataaaaagaagcaatttggtccattagttagatggcttaaagtcaacttcagcgagtgtttctgcgcctggattcacgttaaagcgttgagggtatttgttgaatctgttttaagatatggcctccccgtcaatttccaagctattttaatccaccccaataagaaacaattaaaacgtttaagagatgtcttgaaccaactttacggccacctcgatagtagtgctgccctttcaggacctaacgttgatagcgttgacattccaggcctcggattcggccaatcagagtattacccatacgtttactacaagctgaacgtcgacatgttagaatcgaagatctaaactcacgcatcaatccaagagtttgttattaataggttccaaacaattttaaaaaaacgtactacagatacaaatagtatatttttgattactcactctttcgaggggctgttttaatgtcggtatttttaagttttgtccttactcaatgtccatttagtaccccgtcattgtatgtaaattaattaaaaatgcgcaacaaaaaatgtagaacttttttttattttaaaatgcatttaaaattcgtttaacgatgatataattgctttaatgtatcatgtaatactccgattgaacatataaatcgttattaatattatttcttgttgataatacaaaagagaccatattattagaaactgcattcgaaaaattaaaaaaatgatagatattatgacgcgtagatgagctgacaagtgacgtgttaagatgtattgatatctaaacatgaaatttcaacaaaccatctatgttatagatgtacatatgtttcgtaaaattgacgaaaagctggaaatagattacatataatttgtcataaaatatttgcgtcagagacttgaggttgtgatacaatatatatttactcctacagaatatttgttgaatattaccgacaccattaaaataccttatccgttatgattgtagataaataatttactctgaatttaatacaaaacgatgtcataatttcaattgtacttgttctaataatataactacttatcgaaaaagaatagaaatttattataaaattgtgtgaaatgactgggtattataggattgccccaacaaaatattttagatgtagtatgatgcttcatcagtgacaatatatttgacgtgttttattatgggccactctttaatgtaaaccagtattgatttattgtaaataaatattgtatatatactacaaaccaataaaatattttgccttttgaatctatttataaaagatgattccatattgtaatatagttcaattagttgactactttttttgaatttatttcagaaataattttaagtggttatttgttcaatgtaattgttagaaaataaaaactattccaa

SEQ ID NO: 481 - DNA, 689 bp, Diabrotica virgifera
  misc_feature (1)..(689): RNAi target sequence
  misc_feature (338)..(338): n can be any nucleotide
  misc_feature (551)..(551): n can be any nucleotide
gggcttctttctgtggttaagtccaaaatggcaccgacagctgacaaaactaaaacggttaaagggctccccgcagtcccagaatcagtcttaaaacaccgtaaaagacgtgaagcatcccgtgctaaacaactccagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagnagcacctaaagtacgcaaagtactccaactattccggttacttcaaatcaacaatggagttttcgttaagttgaacaaggctactattaacatgcttaggatatgcgaaccttacattacatggggatatcctaacttaaagtcagtaagagaattaatctacaaaagaggatttgccaaagttaatggacagcgtgtagcaattaccagcantcaaatcgttgaagacaggttggggaaaatctggaatcatttgtgttgaagatttaatccacgaaattttcactgttggacctaagttcaaatatgcctccaacttcttgtggcccttcaagctaaacacacccactg

SEQ ID NO: 482 - DNA, 20 bp, Artificial Sequence
  primer
  misc_feature (1)..(20): forward primer
gcttctttctgtggttaagt

SEQ ID NO: 483 - DNA, 22 bp, Artificial Sequence
  primer
  misc_feature (1)..(22): reverse primer
cagtgggtgtgtttagcttgaa

SEQ ID NO: 484 - DNA, 855 bp, Diabrotica virgifera
  misc_feature (1)..(855): WCRW transcript ta05864.001_diavv
ggggggcgtgtggggggtctttctgtggttaagtccaaaatggcaccgacagctgacaaaactaaaacggttaaagggctccccgcagtcccagaatcagtcttaaaacaccgtaaaagacgtgaagcatcccgtgctaaacaactccagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttttcgttaagttgaacaaggctactattaacatgcttaggatatgcgaaccttacattacatggggatatcctaacttaaagtcagtaagagaattaatctacaaaagaggatttgccaaagttaatggacagcgtgtagcaattaccagcaatcaaatcgttgaagacaggttgggaaaatctggaatcatttgtgttgaagatttaatccacgaaattttcactgttggacctaagttcaaatatgcctccaacttcttgtggcccttcaagctaaacacacccactggtggatggcgtaagaagactaaccactatgttgaaggaggtgactttggtaatagagaagatagaattaatgaacttctcagaaggatggtttaaaccaatttgtttataaaataaattatgtataaaacacaaaaaaaaaaaaaaaaaatgcga

SEQ ID NO: 485 - DNA, 327 bp, Diabrotica virgifera
  misc_feature (1)..(327): RNAi target sequence
acacttacacccttcaaaaactcatttataaactaaaaatgggtgcatctgtaattcctttcatagttttcactgtattatggggaggagttggagctgttctacccatttttgtacctaaaggacccaatagaggaattatccaagttattcttatgataacaggtgtgtcgtgctggttgttctggctgtgttgttacgtagctcaaatgaatcctctgatcggtcctaaactagaacaaaacatcgtgctgattatggcaaaacaatggaaatatgcattaccatcgtcagcttgaatgaaggtgtgagtgaccattccatctg

SEQ ID NO: 486 - DNA, 24 bp, Artificial Sequence
  primer
  misc_feature (1)..(24): forward primer
acacttacacccttcaaaaactca

SEQ ID NO: 487 - DNA, 22 bp, Artificial Sequence
  primer
  misc_feature (1)..(22): reverse primer
cagatggaatggtcactcacac

SEQ ID NO: 488 - DNA, 656 bp, Diabrotica virgifera
  misc_feature (1)..(656): WCRW transcript ta06727.001_diavv
ttcaaggagtggttagattgtatgcactgaatttctgaaggcagatgattttgacagattttagtttactctacttgtaaagtgaaaatctattcacgtgaattattttacacttacacccttcaaaaactcatttataaactaaaaatgggtgcatctgtaattcctttcatagttttcactgtattatggggaggagttggagctgttctacccatttttgtacctaaaggacccaatagaggaattatccaagttattcttatgataacaggtgtgtcgtgctggttgttctggctgtgttgttacgtagctcaaatgaatcctctgatcggtcctaaactagaacaaaacatcgtgctgattatggcaaaacaatggaaatatgcattaccatcgtcagcttgaatgaaggtgtgagtgaccattccatctggatagtgtgtagaaatttcaaattgcacagctattgcattgtattatatttattattaatttcctttttgtgatcatccaatatctgtatgtagtatgttttaaagtgatgtgtataatattgattattgtttatatactatcatcaaaaccaaccattaattgtaaaaaaaatattgttgaattaaattaatttgtcagttaaaaaaaaaaaaaaaaaa

SEQ ID NO: 489 - DNA, 526 bp, Diabrotica virgifera
  misc_feature (1)..(526): RNAi target sequence
tgtatttgtgactggaaaaggaaattagagccctatacttacagttaaacgcttataaatttgtagcaagtattttatctttacaaaagaaagtttatttcttaacattgtagttttatatttttattacaaatggcaactggaactactttgcaaaaagccattgagttagtcaccaaagccaccgaagaagacagaaacaagaattatgaagaagcccttcgtctatatgaacatggagtagagtactttctacatgccattaaatatgaagctcagggtgacaaagctaaggagagcattagggccaaatgtgtacagtatctagaaagggcagaaaaaattaaagaatctgtaaggaaagggaagaagaagccagttttagatggaggttcttcaaaggaagacaaaaagagtgatagtgatgaaggtgacgaagatgatcctgacaaaaagaagttacaaagcaaactggaaggggccatagttgtagaaaaaccacatgtcaaatggagtgatgtggcag

SEQ ID NO: 490 - DNA, 24 bp, Artificial Sequence
  primer
  misc_feature (1)..(24): forward primer
tgtatttgtgactggaaaaggaaa

SEQ ID NO: 491 - DNA, 20 bp, Artificial Sequence
  primer
  misc_feature (1)..(20): reverse primer
ctgccacatcactccatttg

SEQ ID NO: 492 - DNA, 2068 bp, Diabrotica virgifera
  misc_feature (1)..(2068): WCRW transcript ta02217.001_diavv
tgtgaagtgtcaaaactgtcaaaagaattatgccaatgtcaaaagtgtaatttggaggggtgattataaaattattcttagacattacaatatttcatataaagtatttatttaaaagatgtatttgtgactggaaaaggaaattagagccctatacttacagttaaacgcttataaatttgtagcaagtattttatctttacaaaagaaagtttatttcttaacattgtagttttatatttttattacaaatggcaactggaactactttgcaaaaagccattgagttagtcaccaaagccaccgaagaagacagaaacaagaattatgaagaagcccttcgtctatatgaacatggagtagagtactttctacatgccattaaatatgaagctcagggtgacaaagctaaggagagcattagggccaaatgtgtacagtatctagaaagggcagaaaaaattaaagaatctgtaaggaaagggaagaagaagccagttttagatggaggttcttcaaaggaagacaaaaagagtgatagtgatgaaggtgacgaagatgatcctgacaaaaagaagttacaaagcaaactggaaggggccatagttgtagaaaaaccacatgtcaaatggagtgatgtggcagggctggaagctgccaaggaggctttgaaagaagctgttatattacctattaggtttccccatttgttcagtggaaagagagtaccttggaaagggattttgttatttgggcctcccggtactggtaaatcgtacttagccaaggctgtagctacagaagcaaacaattcaacatttttttctgtttcgtcgtccgatctcgtttccaaatggttgggagagtcagaaaaattagtcaagaatcttttcgaattggctagagcccacaaacctagtattatattcattgatgaaatcgattctttatgctcatcccgttccgacaacgaatcagagtcagccaggagaatcaaaaccgagtttttggttcagatgcaaggtgtgggccacgatactgaaggtatccttgtcctcggtgctacgaatattccgtgggtattggattctgctattcgaagaagatttgagaagagaatttacatacctctaccagaagaacctgccagagccgttatgtttaaattgcatttaggaaatactcatacagagctaacagatgaagatattaaagagttggcatctaaaaccgaagggtattccggagctgatataagtatcgtagttcgtgacgctcttatgcaacccgtccgaaaagtccaaactgcaactcacttcaagaaggtcagaggtccgtcgccgcttgatcctaataccatcgtagatgatttgttgcttccatgttctcccggagatccgggagctgtggaaatgtcttggatggatatctccagtgataaattagctgagcctcctgttacagtgaatgacatgctgagatcaatcgcaacctccaaaccaaccgtcaacgacgaagatctcacgaaactcaaaaagtttatggaagacttcggccaagaaggataaaatttaggtatacaccagatttactatttaaaagagagattcttgtataatatttgtattcttttaatgcatatatagatcgtaaaaaccacacaaaactttcaacattttgcattaagtgttattagaaaacaaaagattaatgttgttatactgttgctttaatattatttttttaataaattgaatttttcttttttatattacggccttattatacagtaagatagtatatatttgtattcttaatgataaatgaagttaatgaaacatgtttttagaatattcacttgttctttgtatataaaataataaaacaccgattggtttaaaatacttgtattggcttaaagcaagttatctataagcttcaaagacatactcagtgtcttatccgatttctgttactataaacgatctgattcatttatttatctgttgtaattaaaatctgaaataaaatgtcacaatatgtagattgttttccaccttaggattgg

SEQ ID NO: 493 - DNA, 621 bp, Diabrotica virgifera
  misc_feature (1)..(621): RNAi target sequence
gcgattcggtaaaggagaaagtaaccagaattattttagctgttttcaggaatttgatcgaaaaacccgaagatcaacaagtttcaaaagaacattgtatagctatggtgcaatgcaaagtattgaaacaattggccattttagaacagcgcaagttcgatgatgaagatgtgacagctgatgtcgaatttctaactgaaaaactacagagttctgttcaggatctgagttccttcgatgaatattcaactgaagtcaaatctggacgtttggaatggtctccagtacacaagagcaagttctggcgggaaaatgcgcagcgcctcaacgagaaaaactacgaattactccgtattctcattcatttgttagaaaccagcaaggaccccttggtattgagcgtagctagtttcgatattggagagtatgttcgccattatcctcgcggcaaacacataatcgagcagttgggaggaaagcaattagttatgcaactcttagcccacgaagatcccaatgtacgatatgaagctctgttggcagtccaaaaattgatggtccacaattgggaataccttggtcgtcaacttgaaaaagagcaaagtacagataaaaccgcgc

SEQ ID NO: 494 - DNA, 21 bp, Artificial Sequence
  primer
  misc_feature (1)..(21): forward primer
gcgattcggtaaaggagaaag

SEQ ID NO: 495 - DNA, 22 bp, Artificial Sequence
  primer
  misc_feature (1)..(22): reverse primer
gcgcggttttatctgtactttg

SEQ ID NO: 496 - DNA, 1830 bp, Diabrotica virgifera
  misc_feature (1)..(1830): WCRW transcript ta02168.002_diavv
tacttctgtcagtgtcaaaatttatatcacaagacttccagttgggagttgggtcagagttaattttttaggtcttctattaaaagggttgtaattttaatttaaaaaaatggcatccaatttagttgcgggagcaaatcctaaaatacaggatataatgtcgtctttggacgatgacaaaacagatatgttggctgctacaagtgtattgcagcaaagagctacagatataagaaatcaacatgtaaactggcaatcctatttccagtcacaaatgatttcgcaggaagactacaacttcatagtagcttttgatgtgactgatagtgcaaaaagagaagctctcctgaaaagcgacagaaaccaatgtgctcaaacattgttgaaccttttggggcatgtatccaaggaccaaactctgcagtacattttagttttggttgatgatatgttacaggagaacagaagtcgtgtagagatatttcacgaatatgccaaccaaaagaaagaatctgtttggggtccatttttgaaccttcttaaccgccaggatggatttattaccaacatgacttctaggatcatcgctaaaattgcttgttggtcgcagacacttatggatcgttctgaccttcatttttacttgacctggttaaaagaccaactaaaaactcagaacaacgaatacatccaatcggttgcaagatgccttcaaatgatgctccgaattgacgactaccgttttgccttcgtgtccgtcgatggaatatccactctgttgtcggtactctctggaagagtaaatttccaagttcagtaccagctgatattctgcttgtgggtactcactttcaacccgttgttagccgaaaagatgaacaaattcaacgttattcctatattggcagatattttgagcgattcggtaaaggagaaagtaaccagaattattttagctgttttcaggaatttgatcgaaaaacccgaagatcaacaagtttcaaaagaacattgtatagctatggtgcaatgcaaagtattgaaacaattggccattttagaacagcgcaagttcgatgatgaagatgtgacagctgatgtcgaatttctaactgaaaaactacagagttctgttcaggatctgagttccttcgatgaatattcaactgaagtcaaatctggacgtttggaatggtctccagtacacaagagcaagttctggcgggaaaatgcgcagcgcctcaacgagaaaaactacgaattactccgtattctcattcatttgttagaaaccagcaaggaccccttggtattgagcgtagctagtttcgatattggagagtatgttcgccattatcctcgcggcaaacacataatcgagcagttgggaggaaagcaattagttatgcaactcttagcccacgaagatcccaatgtacgatatgaagctctgttggcagtccaaaaattgatggtccacaattgggaataccttggtcgtcaacttgaaaaagagcaaagtacagataaaaacgcgccaaagggtggagctcctgtcgcaggcaaggcgtaaatactaccatgaaaagtatttaaagatatttactgcaataattgtagaaactttaaaaataattgtaaaaattatatcgatttctgtacatagctgtataggtatacattcctgtcatattttattattgttacgataaccaataatcaaccatgcacattttaaacatttaaaaatattgcttttaaagtaacttttttctgattgttagtattataataaagtatatgttgtcgtttaaaaaaaaaaaaaaaaaa

SEQ ID NO: 497 - DNA, 642 bp, Diabrotica virgifera
  misc_feature (1)..(642): RNAi target sequence
gggaacctttttctggaggttaggaaaagtacgtgacattttcactttattttccatacagtttaaacaatattgtattcttgtagttattgcctgaaaataatcactttttaagattagcaatgccagcagctgacgaaataaagtccagctgggctgacgaggtagagttagaaggaggtgccttaccaccacccagtgaagtcttcgaaaatggtttcaagattgtaactgaatataaatacaatgaagacgacaagaaagttaagattgtcaggacgtacaaaattgagaaacgtgctgtgtccaagtcaattgctctccgtaaaacatggaaaaagtttggtgatgttgccaatgataaacctggcccgaatcccgcgactaccatagtagctgaagacgtttatatgcagtacatcactagtaaggaagaagataataagcaggatgatgactctttggacaaactgaaaggaatgggtgataagaaattctttaaatgtcgtacatgtaatggtgaacattggactacaaaatgtccatggaaggacactatgtttgttggtggaaagccaccagatgataagaaaatatcagctgttggaggggcagctgttggtgaagctggtaaacaaggat

SEQ ID NO: 498 - DNA, 20 bp, Artificial Sequence
  primer
  misc_feature (1)..(20): forward primer
gaacctttttctggaggtta

SEQ ID NO: 499 - DNA, 22 bp, Artificial Sequence
  primer
  misc_feature (1)..(22): reverse primer
atccttgtttaccagcttcacc

SEQ ID NO: 500 - DNA, 1014 bp, Diabrotica virgifera
  misc_feature (1)..(1014): WCRW transcript ta06291.001_diavv
cggcaacctttttcttgaggttaggaaaagtacgtgacattttcactttattttccatacagtttaaacaatattgtattcttgtagttattgcctggaaataatcactttttaagattagcaatgccagcagctgacgaaataaagtccagctgggctgacgaggtagagttagaaggaggtgccttaccaccacccagtgaagtcttcgaaaatggtttcaagattgtaactgaatataaatacaatgaagacgacaagaaagttaagattgtcaggacgtacaaaattgagaaacgtgttgtgtccaagtcaattgctctccgtaaaacatggaaaaagtttggtgatgttgccaatgataaacctggcccgaatcccgcgactaccatagtagctgaagacgtttatatgcagtacatcactagtaaggaagaagataataagcaggatgatgactctttggacaaactgaaaggaatgggtgataagaaattctttaaatgtcgtacatgtaatggtgaacattggactacaaaatgtccatggaaggacactatgtttgttggtggaaagccaccagatgataagaaaatatcagctgttggaggtgcagctgttggtgaagctggtaaacaaggatccaaatatgtaccacctaatttgagagatggaggtgtgaagagaactgatggatctggtgtagctaaacgagatgatagttcctgtgctatcagaattgccaatttgagtgaatccacaactgaaactgatttggaagatctggttaaacaatttggaccaattcaaaaactgtatttggcgaaagacaagataactggtggatgtaaaggatttgcttatatacatttcaaattccgttctgatgcagctaaggcaatcgcaatgcttcatggacatggttatgatcatcttattcttaatgttgattggtccaagccatcaccaaattctaaccaataattgtatcaccagatttttgaataataaaat

SEQ ID NO: 501 - DNA, 524 bp, Diabrotica virgifera
  misc_feature (1)..(524): RNAi target sequence
tcaacgtcatctcagtttggtttattgttgggtgtaatgtttaaataaaataattattattttgtaaacctgtgccattaaacaaataaagcgatggtgctaattgcagcagcagtctgcacgaaagcaggcaaaacaattgtgtctcgacaatttgttgaaatgaccaaagctagaatagaaggtttgttggctgcctttcctaaattaattcctacaggaacccagcatacatttgtggaaacagattcagtacggtatgtttatcaacccctagagaaactgtatatggttcttattacagctagagctagcaacatattagaagatcttgaaaccctccgtctattcgcaagagtgattcctgagtactgcaaatctttggatgaaaatgaaattgcagagaatgcattttcacttatatttgcttttgatgaaatagtggcattaggttatagggaaagtgtcaatctgtctcaaattcgcacatttgtggaaatggactcgcacgaagaaaaagttta

SEQ ID NO: 502 - DNA, 22 bp, Artificial Sequence
  primer
  misc_feature (1)..(22): forward primer
tcaacgtcatctcagtttggtt

SEQ ID NO: 503 - DNA, 23 bp, Artificial Sequence
  primer
  misc_feature (1)..(23): reverse primer
taaactttttcttcgtgcgagtc

SEQ ID NO: 504 - DNA, 1812 bp, Diabrotica virgifera
  misc_feature (1)..(1812): WCRW transcript ta03896.001_diavv
cgaagatccttgtcacgtcactgctttttcgtgaagggggggtacacgtcaacgtcatctcagtttggtttattgttgggtgtaatgtttaaataaaataattattattttgtaaacctgtgccattaaacaaataaagcgatggtgctaattgcagcagcagtctgcacgaaagcaggcaaaacaattgtgtctcgacaatttgttgaaatgaccaaagctagaatagaaggtttgttggctgcctttcctaaattaattcctacaggaacccagcatacatttgtggaaacagattcagtacggtatgtttatcaacccctagagaaactgtatatggttcttattacaactagagctagcaacatattagaagatcttgaaaccctccgtctattcgcaagagtgattcctgagtactgcaaatctttggatgaaaatgaaattgcagagaatgcattttcacttatatttgcttttgatgaaatagtggcattaggttatagggaaagtgtcaatctgtctcaaattcgcacatttgtggaaatggactcgcacgaagaaaaagtttatcaggccgtgagacagactcaagagcgcgaggccaagaatatgatgagagaaaaggcaaaagaacttcagagacagaagatcgaagcggccaaaaaaggagggaagacctcgtttggtagtagcggtggctttggcagctcgacaggttatactcctacgccatctgttggtgatgtagctaaccagacaaatgatgttaaaacttcttcatacacaccagcccctgcgcaaaaacctcggggtatgaaattaggtggaaaaggtagagatgtagaatcattcgtagatcagcttaaatcggaaggagaaaacgtcattactccaaacaaaaatagtatttcacagccaggaactaaagctccagctatcaaaactgacatcgatgatgttcatttaagattggaagaaaaattaatagtgagaataggtcgtgatggtggcgtacaacaattcgaattattgggacttgctactttacacattggagatgagagatggggtaggatacgtgtgcaattggaaaatcagaatacccacggtgttcaacttcaaacgcatcctaatgtagataaagaattattcaagctacgctcacagattggattgaaacaaccggctaaaccttttcctctaaatacagatgttggtgtactgaaatggagattacaaagtactgaggaagctctaattccactcttaataaattgctggccttcagaagcgggagatggtagttgcgatgttaatatagaatatgagcttgcccacactaatttggaactagttgatgtcaatattgttattcccttgccaattggatgttcaccaatagttggtgaatgtgatggtatgtacacacacgaagccaagcgtaatcaactggtatggaatttgcctctgattgatgccagtaataaaactggttctttagaatttaacgctcctagggccatacccgctgatttcttcccgctttccgttggattcaattcgaagtcatcctatgcgagtattaagattaccgaagttgtcctagttgatgatgattctcctataaaatattcagtggagaccgcactatatccagataaatatgaagtagtataatggggcagaagtaaagaatcacttgtaaaaattatataactaatattatatcttatatgcaacattgctttttgtacaaaagttaagtaacttgtctttattttatctatattaataaaataagtaagaaag

SEQ ID NO: 505 - DNA, 612 bp, Diabrotica virgifera
  misc_feature (1)..(612): RNAi target sequence
attctgatcccagcacacaaattttgtataaccggacaatggcgcatttgggattgtgtgcatttagacacgctaacattaaggatgcccataactgtttagttgatttgatgatgactggaaaaccaaaggagttactggcacaaggtttgcttccacaaagacaacacgaacgcagcaaagaacaggagaaaatcgagaaacagcgtcaaatgcccttccacatgcacatcaatctcgaactcttagaatgtgtgtatttagtctccgccatgttgatcgaaatcccgtatatggctgcgcatgaattcgacgccagacgcaggatgatttctaagaccttctatcagcagttgcgttcttccgaacgtcaaagcttagtgggacctccggaaagcatgcgagagcacgtcgtcgcggcggctaaagcaatgatgaacggcaattgggcggcatgcaacacttttatcattaacgacaagatgaatgccaaagtgtgggatctgttttaccaagccgaccaagttagatccatgttgacgaaattgataaaagaagagtctttgaggacgtatttgtttacctactcccacgtttacgattcaatttcga

SEQ ID NO: 506 - DNA, 22 bp, Artificial Sequence
  primer
  misc_feature (1)..(22): forward primer
attctgatcccagcacacaaat

SEQ ID NO: 507 - DNA, 22 bp, Artificial Sequence
  primer
  misc_feature (1)..(22): reverse primer
tcgaaattgaatcgtaaacgtg

SEQ ID NO: 508 - DNA, 2785 bp, Diabrotica virgifera
  misc_feature (1)..(2785): WCRW transcript ta05048.001_diavv
caatgactaatgtcacctcgctcttttaactcacgttgcatatgtgaggtattttccaaaattcgagaaaagtttatttagtgttattataataagggaaaacagtaaaaatgagtagatttttcgctggatccgattcagattcggatagctcatccgaagaagagattatccaacgtccccaagtaccagcttatactttcagtgacgatgaggaggaggtaaaacgtgtagtaagatcagcgaaagaaaagcgctatgaagaacttacaaatactattaaacaaatcagaaattttaagaaaattaaggatatgtctagcatgttgaatagttttgaggaattacaaaaggcataccaaaaagctgctcctgttattgtcaaagaagaaaatggccagactccaagattttttattaggtgtttggccgaaatggaagactttattaatgaaatgtgggaagatagagatgggaggaaaaacatgagcaaaaacaatagcaaatcactcacatctatgagacagaagttgagaaaatatttgaaagattttgaagatgacttggctaaatttaaggaaaacccagaacagcctgatgatgaggaagaggaggaaaagcctgaagtagctgaggattccgagaacgaagctccatccaaaaacgcgtttctcaaagctccacccaaacaagttgtagacgacaaagatgaatcgtcagactcggatgactggccatctgactctgaatctagtctgtcatcatctgatgacgacgaaggcaaataccagagcataagggagcgtttcttgaagagaactgggcccgctcacgaagaagatgaagaaagggaaaggagaaaggaggagaaaaggaaggagagaaaggagaaaggtaggaagttgaaaaaggatgaggaggaggatggtgaaggcaagtgggagactgttaatcgaggtttcgccatccctagtgaaaaacctaaaatgttcgccaaggacgccgaaatcgatctaaaccttgtaatcaagaaactcagcgaaatcatggcagctagaggcaaaaagcgcacagatagacgcgaacaaatagaactcctgcacgaactccaaaatgtttctgagcaacaccaattgggagcggctattttcattaaaattaaactcgccatcatatctgccattttcgattacaaccccaaagtttctgacgcaatgaagccggagtattggctgaaattgctggagaggatgagcgaaatgttgggcatgttgttgaatactaccaatctagtagtttctgatggaattactgaagaaatggaaaatcttgaagaacccccgtatcgcattaggggctgtatactaacatcagtggaaagactggatgacgagtttactaaactactcaaagagtgtgatcctcacagtaacgagtatgtagaacggttaaaggatgaatgtaaggtttctagtatcatcgataaaacaatgaaatacttggaaaggagtaacgtatcttccgaactatgtaggatatatttacgaaaaatcgagcatttgtattacaaattcgatcctagagtattacagcaaaaagctgatcctctcgtagtacccaaagacgagatgaactccgtgcaagaaatggagaaactatgcaaatttatctacgcaaaagatagtactgacagattgagaactagagctattttgtcccatatatatcatcacgctctgcatgacaactggttccaagcaagggatttggtattgatgtcacatctacaagaaacgattcagcattctgatcccagcacacaaattttgtataaccggacaatggcgcatttgggattgtgtgcatttagacacgctaacattaaggatgcccataactgtttagttgatttgatgatgactggaaaaccaaaggagttactggcacaaggtttgcttccacaaagacaacacgaacgcagcaaagaacaggagaaaatcgagaaacagcgtcaaatgcccttccacatgcacatcaatctcgaactcttagaatgtgtgtatttagtctccgccatgttgatcgaaatcccgtatatggctgcgcatgaattcgacgccagacgcaggatgatttctaagaccttctatcagcagttgcgttcttccgaacgtcaaagcttagtgggacctccggaaagcatgcgagagcacgtcgtcgcggcggctaaagcaatgaggaacggcaattgggcggcatgcaacacttttatcattaacgacaagatgaatgccaaagtgtgggatctgttttaccaagccgaccaagttagatccatgttgacgaaattgataaaagaagagtctttgaggacgtatttgtttacctactcccacgtttacgattcaatttcgatggccactttggcggaaatgttccagttgggcaaacccgtcgtgcattctattatttctaagatgatcattaacgaagaattgatggcatctttagacgacccgactcaaactgttgtaatgcacagaagcgaaccatcccgtctacaatctttggctttgcaactggcggataaaatcaacaatttcgtcgattccaacgaaagaatattggaatccaaacaaggaaacttcttcctaaggggagcaaaccagggcaatttccgaggagataggcagaactaccgcggaaataaccaaaactgggataggcaacgtcgagacagggatagaaaggaaaaagataattattaataaacatagatcttttg

SEQ ID NO: 509 - DNA, 503 bp, Diabrotica virgifera
  misc_feature (1)..(503): RNAi target sequence
ggggctctttagttgtcatctgtcatttaagtagtaatttcattccaaaatgaagatcggactttgtgcttacagcgggtacaaaatttaccccggacatggcaaaacaatggttaaagttgatggaaagaccttcattttcctcaactcaaaatgtgaaagggcgcacttgatgaaaaggaacccccgtaaagtaacatggactgtcttgtacagacgtaaacataagaagggtcaggaggaagaagccaccaaaaaacgtaccagaaggacacagaaattccaaagggctattgtaggtgcttctttaaatgatatcatggccaagagaaaccaaaggcctgaagtaaggaaggcccaaagggagcaagccattcgtgccgctaaggaacagaaaaagagcacaaagacagccaggaaggctacagcccccgccaaggccaaacctgctcctaaacagaaagtaaccaagaatcaacccaaagctgcacctagagtaggag

SEQ ID NO: 510 - DNA, 19 bp, Artificial Sequence
  primer
  misc_feature (1)..(19): forward primer
gctctttagttgtcatctg

SEQ ID NO: 511 - DNA, 23 bp, Artificial Sequence
  primer
  misc_feature (1)..(23): reverse primer
ctcctactctaggtgcagctttg

SEQ ID NO: 512 - DNA, 2131 bp, Diabrotica virgifera
  misc_feature (1)..(2131): WCRW transcript ta01391.001_diavv
aaagatggaaggaaatgaggccaatacttagcccatcgttcacaagcagcaaaatgaaatcgatgtttatgctgatgtcagaatgtggcgaaaagttggtcaaattttttatggaaaaagaccagaatgctatagaaattgaaatgaaagacacattaacgcgttatactaatgatgttattgcctctgcagctttttggagtacagattgattctttaaacaacactgaaaatgaattctatctcatgggaaaaaatgcaaccaatttccgtggtttctggaggactatgaagttgtttggatatatgattataccaaaaatatttgagttctttaaagtgacattgtttgatatgaacgttcgacgattttttactgaattgattagtggaacaataaagatcagggaagagaaaggcattattcgtcccgatatgattcacctactcatgcaagcaagaaaaggaatccatcaaaaagaagaaaaggttgttgatgctggatttgctgtagtacaagaatcgaatttagaatcaaaagtagttgcgacagaaatgaccgacttagacatctgcgctcaagcattgattttcttctttgctggatttgagacggtctcgtcaaccatgtgctttgtggctcatgaattggcctgtaatcctgatgtccaatcgagattaagagatgaaatacgtgaaacactcgatcaatgtaatggaaaagtaacctacgaagctatgttgaaaatgaaatatctggatatggtaatatcagaatccatgaggaaatggccagcagttatagctgttgatcgaatttgcaccaaaccatacacactcgaaccagcaacactcgatgagaagcccctccacttagacaaaggcaccataatctggttccccatttacggtctccaccgcgatcctaaacactacccagacccagaacggtttgatcctgaaagattcagcgatgaaaacaaaggaaacatcaatccatacgcttaccttccatttggagtcggccctagaaactgcatcggttccagatttgctttattagagatgaaagtattgtttttccatttgttagccaattttgagattgtgccaggtccaaagacggaaattcctttgcggatttgtaagaaacaattcggtttgactgcagaaaatggtttttggttcaacttgaagaaactgaagaattagtctttgatatgtttgataaaagtcttgataaaatattgtttaaccatatctacttatttggtgtaatgtattttctagtcataattcttttaaactttttcttaacgtttcagcgggcgcaccctataatttcacatgagaagacgcgtgtcgtagattatacgtctttgcgtaaataatgtcttcttcaaataaatgtttggaaattgttacaatgatattttcttcttcttcctgcttccttataggctcgcatctgttctatcttcggatgcctcttcatcagatatccgcagcacgtccacacaggtaaacctaaacataaaaacgggggctctttagttgtcatctgtcatttaagtagtaatttcattccaaaatgaagatcggactttgtgcttacagcgggtacaaaatttaccccggacatggcaaaacaatggttaaagttgatggaaagaccttcactttcctcaactcaaaatgtgaaagggcgcacttgatgaaaaggaacccccgtaaagtaacatggactgtcttgtacagacgtaaacataagaagggtcaggaggaagaagccaccaaaaaacgtaccagaaggacacagaaattccaaagggctattgtaggtgcttctttaaatgatatcatggccaagagaaaccaaaggcctgaagtaaggaaggcccaaagggagcaagccattcgtgccgctaaggaacagaaaaagagcacaaagacagccaagaaggctacagcccccgccaaggccaaacctgctcctaaacagaaagtaaccaagaatcaacccaaagctgcacctagagtaggaggaaaacgttaatattgtataaacgttatttaataaaataagtttttttccataaaaaaaaaaaaaaaatgcgaaaaaaaaacatgt

SEQ ID NO: 513 - DNA, 502 bp, Diabrotica virgifera
  misc_feature (1)..(502): RNAi target sequence
aaagtttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccctcgtacctagagatggttgcttaaaccatatagaagaaaacgatgaagttctagttgcaggttttggacgtaaaggtcatgctgtaggagatattcccggagttagatttaaggttgttaaggtcgctaatgtgtccctattagctttatacaaagaaaagaaggaaaggccaagatcataattaaaatgttattttttttatttatttgcttggcacttttaatttttaaa

SEQ ID NO: 514 - DNA, 22 bp, Artificial Sequence
  primer
  misc_feature (1)..(22): forward primer
aaagtttttgagccgtcaacat

SEQ ID NO: 515 - DNA, 24 bp, Artificial Sequence
  primer
  misc_feature (1)..(24): reverse primer
tttaaaaattaaaagtgccaagca

SEQ ID NO: 516 - DNA, 616 bp, Diabrotica virgifera
  misc_feature (1)..(616): WCRW transcript ta00545.001_diavv
ggggattttcggttggggggttgggagcagttatgggggctttccggtcaaagtttttgagccgtcaacatgggtaagccccgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatagaagaaaacgatgaagttctagttgcaggttttggacgtaaaggtcatgctgtaggagatattcccggagttagatttaaggttgttaaggtcgctaatgtgtccctattagctttatacaaagaaaagaaggaaaggccaagatcataattaaaatgttattttttttatttatttgcttggcacttttaatttttaaataaagtgttaagcatataattttgtacagtgttttatttcaataaacaattttatacctgaaata

SEQ ID NO: 517 - DNA, 719 bp, Diabrotica virgifera
  misc_feature (1)..(719): RNAi target sequence
gggtgatccttcagttttcgtccacgcgtgtcaaaatggcgaaaaagaaaccagaggataaaaataatcaaagcgatgatgatacaaaaaacgagagtgattactcgtcgaacgaagaagaaccaaacttcagtgatcctgaagactacgaagacgatgtctctgatgaagaactcttaggtgatgttttaaaagaaaagcctaaggaaactgatggagtagaaagtgttatagtagtagatggagttcctcaagtaggtcctaatcgtattgaaaagttgaagtcagtcattgtcaaaatatttgtgaagtttggaacaatagtaaatgaattctaccctgtcaatagtgagggccacaccaaaggttatatctttatagaatattcctcaccatctgaagctgctgaggctgttaagctcactaacaattttaaattggataagcaccatacctttcaagttaacctctttactgatttttctaagtatgaccaaattcctaataagtgggaccctccagagccacaaccttaccaagggcaagcagacttgcattcttacttattggaaccggatgcatatgatcagtttgctgtagttgttgcacaaacacaagctgtgcaaatttggcagaatacacagcctgatcctagtctcattgaagctagaaacagctggagtcaaacgtacataaaatggtcacctctgggtacattc

SEQ ID NO: 518 - DNA, 19 bp, Artificial Sequence
  primer
  misc_feature (1)..(19): forward primer
gtgatccttcagttttcgt

SEQ ID NO: 519 - DNA, 22 bp, Artificial Sequence
  primer
  misc_feature (1)..(22): reverse primer
gaatgtacccagaggtgaccat

SEQ ID NO: 520 - DNA, 2397 bp, Diabrotica virgifera
  misc_feature (1)..(2397): WCRW transcript ta01172.001_diavv
gggggtgatccttcagttttcgtccacgcgtgtcaaaatggcgaaaaagaaaccagaggataaaaataatcaaagcgatgatgatacaaaaaacgagagtgattactcgtcgaacgaagaagaaccaaacttcagtgatcctgaagactacgaagacgatgtctctgatgaagaactcttaggtgatgttttaaaagaaaagcctaaggaaactgatggagtagaaagtgttatagtagtagatggagttcctcaagtaggtcctaatcgtattgaaaagttgaagtcagtcattgtcaaaatatttgtgaagtttggaacaatagtaaatgaattctaccctgtcaatagtgagggccacaccaaaggttatatctttatagaatattcctcaccatctgaagctgctgaggctgttaagctcactaacaattttaaattggataagcaccatacctttcaagttaacctctttactgatttttctaagtatgaccaaattcctaataagtgggaccctccagagccacaaccttaccaagggcaagcagacttgcattcttacttattggaaccggatgcatatgatcagtttgctgtagttgttgcacaaacacaagctgtgcaaatttggcagaatacacagcctgatcctagtctcattgaagctagaaacagctggagtcaaacgtacataaaatggtcacctctgggtacattcttatgtacttttcacaggttgggtgttgcattgtgggcaggacctggatttttgcaatacaaaaaatttacccattcaaatgttcaatttattgatttctcgccatgtgaaaagtatttagtgacttattccccacaaggagacccacataatccagaacagaaaaggatcatcatttgggatattaggacaggtcttgaaaagcgttcattcaatccagaaggtccaacagcatggccaatcttcaggtggtctcatgacgacaaatattttgctcgtattggtcaaaacaatgatgcccttcaagtatacgaaacaccatcttttggtcttctagataagaaatcaatcaaaattaacggcataagagatttcaattggtcgcccacagataatgttgtagcttattgggtagccgaagacaaagatgtgcctgccagtgtaactctgttagaattaccaaacaggaatgaaattagaaagaagaatttgtttaatgttgctgactgtaagatacactggcagaagtctggagattacctgtgtgtcaaggtagacaggtattcaaaggttcgcaaggagaagaatgaaaccaagtattcaggtatgtactgcaactttgaaatattccacatgaaggagaagcaaatacctgtagacagtgtagagtgcaaggaacccattcaggcgtttgcatgggagccggttggttctaaatttgcaatgatccatggcgaatcccccagcatcagtgccagtttctacgaggttaggataggacaggctcctatccttctcaagaaatttgagaaaagagcttgcaaccatctgttttggtctcctagtgggcagttcatagttttagcaggcttgggttccaacggaggtggatcgctggaatttgttgatactcacgaatttttaatcatgaacactacagaccatttccaattgtcagatgtagagtgggatccaactggaagatatgtaattactggagtctcattttggaagaccaaggttgatacaggttattggatttggtccttccaaggaaaaatcctcaagcgcatcaatttggaaaagttctcccagattctctggagacctagaccaccatcattactcagcgatgaaaagcaaaaggaggtcaagaagagcctaaagaaatactacccgcagttcgagagcaaagacaggatgcgacaatccaaggcttccaaggaacttatcgagaagagagctgctcttatggagaaattccaagcctacagagaggagaggatcgaggagtacttggaccaaaaatcaaggcgtttgcagcttagaaataacattgacactgatgaattaaatgcagagaacgttgaggaggaaatcgtagaattctttattaaagaagaagtaattccagtcgactagcaccatcttgaaagtccggtcctttccctgcgtgtgctttgttacaacacattcagggagatttaaagtgaaaacgttaaatattataatataaaaaatatttgtattttggacattgacataaatatttgttaatcaagtgtctcgttcaattaatagtgttttatatttttgacacgcgtaccatctttccaaaaactaatgaacattgttattaaacgccttgtggttactaaaataaaaaattcaataag

SEQ ID NO: 521 - DNA, 639 bp, Diabrotica virgifera
  misc_feature (1)..(639): RNAi target sequence
ccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtaggagccgtatcacctcctggtggtgatttctcagatcctgttaccactgctactcttggtattgtacaggtgttctggggtttggacaagaaacttgcccaacgtaagcacttcccttcagtagactggcttggatcatattccaaatatttaagagcattggacgacttttatgacaaaaacttccaagagtttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagatttcttgcaacaaaactcatactcttcttatgacagattctgtccattctataaaactgtcggtatgttgagaaacatgatcggtttgtacgacat

SEQ ID NO: 522 - DNA, 22 bp, Artificial Sequence
  primer
  misc_feature (1)..(22): forward primer
ccgtgatatgggttacaacgta

SEQ ID NO: 523 - DNA, 22 bp, Artificial Sequence
  primer
  misc_feature (1)..(22): reverse primer
atgtcgtacaaaccgatcatgt

SEQ ID NO: 524 - DNA, 2533 bp, Diabrotica virgifera
  misc_feature (1)..(2533): WCRW transcript ta01291.009_diavv
cggagatgaagagaagggtcagtcagctgacttatcttatgacaagttgttcagtttgggaaaactcgtccataatggggatagttgagtgggtgaggttccaagagaaacataacatccatccacaaatatgtcgaaagtaaggatcggagatgaagagaaggaagggcagtatggttatgtccatgctgtctcaggtccagtcgttactgctgagaaaatgtctggttctgctatgtacgaactggtacgtgtcggatactatgagctggtaggagaaatcattagattggaaggtgacatggctactattcaggtatacgaagaaacatcaggtgtaactgttggtgatccagtattaagaactggtaaaccactttcagtagaacttggacctggtattatgggttccatttttgatggtatccaacgtccattgaaagacatttgtgacgctactgatagtatttacatccccaagggtattaatgtaccttctttatcgagaacagcaaaatgggacttcaacccaatcaacatcaagttgggatctcacttaactggaggtgatatatatggtctagttcatgaaaacacccttgtcaaacacaaaatgattctgcctcctagagctaagggtactgtaacctacattgcagaaccaggaaactacactgttgatgaagtagtattggaaactgaatttgatggtgatcgtaccaaatatactatgttgcaagtatggcctgtacgtcaagcaaggccagtcagtgaaaaattacctgccaaccatcctctgcttacaggacagcgtgtacttgatgctcttttcccatgtgtacagggtggtactactgccattcccggagctttcggttgtggaaaaactgtaatttcacaatctctttccaaatattccaactctgatgtcattatctacgtcggttgcggagaaagaggtaacgaaatgtctgaagtattgagagatttccctgaattgactgttgaaattgacgggcacactgaatctattatgaaacgtaccgcattggtcgccaacacatctaacatgcctgtagctgctcgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtaggagccgtatcacctcctggtggtgatttctcagatcctgttaccactgctactcttggtattgtacaggtgttctggggtttggacaagaaacttgcccaacgtaagcacttcccttcagtagactggcttggatcatattccaaatatttaagagcattggacgacttttatgacaaaaacttccaagagtttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagatttcttgcaacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattttatatcaacttagcagtatgaaatttaaggatcccgtaaaagatggtgaagctaaaatcaaggcagattttgatcaattatatgaagatattcagcaggccttcagaaacttagaagattaaatctttttaaggaaattttcctattttgttcatcagtgtaagtttaaaaatatagcgatatttatcaaaaagaataataaggcctctatccctcacttctgtgaatattaatatggccgtactaatgatagtaactaaagataggttttctcttttttgatattatcctgtacaaaataaattatgtaaattgttgaatatgtgtatagtttttttgggtgagggtacagtgcttattaaatactttttaaacatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatcattattgttgttaaaaaaaaaaaaaaaaaaaa

SEQ ID NO: 525 - DNA, 507 bp, Diabrotica virgifera
  misc_feature (1)..(507): RNAi target sequence
ggggtccttttactgtgtttcttaggatttggaaggtacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagaccggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaatgaaaagctacgtaaagaagctaaagaaaagaacattaaagtagaacttaggagacaacctgcccaacctaggccagcacatattgttagcggaaaggttccagcacaggtgcttgctcctatcccatat

SEQ ID NO: 526 - DNA, 20 bp, Artificial Sequence
  primer
  misc_feature (1)..(20): forward primer
gtccttttactgtgtttctt

SEQ ID NO: 527 - DNA, 21 bp, Artificial Sequence
  primer
  misc_feature (1)..(21): reverse primer
atatgggataggagcaagcac

SEQ ID NO: 528 - DNA, 696 bp, Diabrotica virgifera
  misc_feature (1)..(696): WCRW transcript ta01222.003_diavv
cgataactgagtttccttcaatgataagttcatccttttgtttggtggagtttactactggaacacctggggggagagggggacagcgacatttcctccgccgggtccttttactgtgtttcttaggatttggaaggtacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagacaggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaacgaaaagctacgtaaagaagctaaagaaaagaacgttaaagtagaacttaggagacaacctgcccaacctaggccagcacatattgttagcggaaaggttccagcacaggtgcttgctcctatcccatatgaattcattgcttaggtttgtttatcttaaaataaaatcctttatataataaaaaaaaaaagaaaaaatcggcagatcccttaaaaaa

SEQ ID NO: 529 - DNA, 519 bp, Diabrotica virgifera
  misc_feature (1)..(519): RNAi target sequence
ggtcagtgaagccatcttggcaaacgttagtaacgtgaaataaaacttaaattttttcaaaatgggtcgtatgcacgcaccaggaaaaggtattgcccagtcggcattgccatacagaaggagtgtaccaacatggttgaaagtcacaccagaagaagtaaaagaccatatttttaaacttggcaagaaaggcttgactccatcacaaattggtgttatcctcagggattcatatggtgttgcccaagtaaggtttgtttctggaaacaaaatcttgcgtatcatgaaagctatgggtcttgcccctgatctaccagaagatttgtactaccttatcaagaaggcagtagctatccgcaaacatttagaacgtaacagaaaagacaaggacagcaaattccgtttgattttggtagaatcacgtatccaccgtttggctaggtactacaaaaccaagagcgtattggcacccaactggaagtacgaatcaagcacagcatctgctttggtcgcttaaat

SEQ ID NO: 530 - DNA, 19 bp, Artificial Sequence
  primer
  misc_feature (1)..(19): forward primer
gtcagtgaagccatcttgg

SEQ ID NO: 531 - DNA, 22 bp, Artificial Sequence
  primer
  misc_feature (1)..(22): reverse primer
atttaagcgaccaaagcagatg

SEQ ID NO: 532 - DNA, 596 bp, Diabrotica virgifera
  misc_feature (1)..(596): WCRW transcript ta05572.002_diavv
ggggctgggctcagtgaagccatcttggcaaacgttagtaacgtgaaataaaacttaaattttttcaaaatgggtcgtatgcacgcaccaggaaaaggtattgcccagtcggcattgccatacagaaggagtgtaccaacatggttgaaagtcacaccagaagaagtaaaagaccatatttttaaacttggcaagaaaggcttgactccatcacaaattggtgttatcctcagggattcatatggtgttgcccaagtaaggtttgtttctggaaacaaaatcttgcgtatcatgaaagctatgggtcttgcccctgatctaccagaagatttgtactaccttatcaagaaggcagtagctatccgcaaacatttagaacgtaacagaaaagacaaggacagcaaattccgtttgattttggtagaatcacgtatccaccgtttggctaggtactacaaaaccaagagcgtattggcacccaactggaagtacgaatcaagcacagcatctgctttggtcgcttaaattgtgcttttatgttaagtttataaaataaaaatttctactaaaaaaaaaaaaaaaaaatcggaaaaaaa

SEQ ID NO: 533 - DNA, 600 bp, Diabrotica virgifera
  misc_feature (1)..(600): RNAi target sequence
ggacagcttttcactgtcattcgtcattctgatacatttttttgggtactttgggttgtacttgggataaaagacctttttgtatttccaaatacattgtcatataaattaaaaaagaaatggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaagctgaagcctccattgccgttgaagtgggagaagcgttagtcaaagcggctgaataataat

SEQ ID NO: 534 - DNA, 22 bp, Artificial Sequence
  primer
  misc_feature (1)..(22): forward primer
ggacagcttttcactgtcattc

SEQ ID NO: 535 - DNA, 22 bp, Artificial Sequence
  primer
  misc_feature (1)..(22): reverse primer
attattattcagccgctttgac

SEQ ID NO: 536 - DNA, 797 bp, Diabrotica virgifera
  misc_feature (1)..(797): WCRW transcript ta03508.001_diavv
ggtaggggagtgacagacagtcaggtggacagcttttcacggggattcgtcattctgatacattttttttgggtactttgggttgtacttgggataaaagacctttttgtatttccaaatacattgtcatataaattaaaaaagaaatggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaagctgaagcctccattgccgttgaagtgggagaagcgttagtcaaagcggctgaataataatttaatttttgtaattttatgtaaatttaataaattagtgtctcaatggtactgttcattttaaaacaacaacatattagatctatacctctatgagttacaatttttacaaaaacgagaatcaatccaaatacataatttttgtttaccgttaaaaaaaaaaaaaaaaaa

SEQ ID NO: 537 - DNA, 612 bp, Diabrotica virgifera
  misc_feature (1)..(612): RNAi target sequence
gggggtttgtaaatctagtcattacagaaacagtaataataaattaccttgttctgattattttgtagaaattgtaaaatggaaaagtggtgtttttgtttgtttcttctttttatatggtttgtttccgcacgtggtgccaacaactcggagtatcctgacctacggccagaatggtcctattgttatgagttcacttggtttgggccagattataataacgtgtccacgtacaataatacgtgtgccgattatctggacgaaacaagagccgaaggtataccctgcgctgctcccatcgtaatatcgtatgatggaacgttaccggatatgcagtatctctgggacaaccacaaagaaagcgtactctgcaaacgcagcataaaccagatgtgtgtcaagtacacttacctctttaaccagaaaattgaaaatattacctacatgtgttctaaagttcagcatgaaggtgggggaaatattgacagtggatgctataaacagaaattggaaagaggatatgaaacagaagtgtgtgtatgtcaatcctccaatggaatttatcctccctgcaacagaagtgcctccatatttggttcgatcaatgttttc

SEQ ID NO: 538 - DNA, 19 bp, Artificial Sequence
  primer
  misc_feature (1)..(19): forward primer
gtttgtaaatctagtcatt

SEQ ID NO: 539 - DNA, 22 bp, Artificial Sequence
  primer
  misc_feature (1)..(22): reverse primer
gaaaacattgatcgaaccaaat

SEQ ID NO: 540 - DNA, 893 bp, Diabrotica virgifera
  misc_feature (1)..(893): WCRW transcript ta03675.001_diavv
ggtttgtaaatctagtcattacagaaacagtaataataaattaccttgttctgattattttgtagaaattgtaaaatggaaaagtggtgtttttgtttgtttcttctttttatatggtttgtttccgcacgtggtgccaacaactcggagtatcctgacctacggccagaatggtcctattgttatgagttcacttggtttgggccagattataataacgtgtccacgtacaataatacgtgtgccgattatctggacgaaacaagagccgaaggtataccctgcgctgctcccatcgtaatatcgtatgatggaacgttaccggatatgcagtatctctgggacaaccacaaagaaagcgtactctgcaaacgcagcataaaccagatgtgtgtcaagtacacttacctctttaaccagaaaattgaaaatattacctacatgtgttctaaagttcagcatgaaggtgggggaaatattgacagtggatgctataaacagaaattggaaagaggatatgaaacagaagtgtgtgtatgtcaatcctccaatggaatttatcctccctgcaacagaagtgtctccatatttggttcgatcaatgttttcctagtatttggaatactatggttatttgtttataaattattttgactaaaattgttgttattcatatctctgtataaaactttaaaaatctcaatacttactaaatttcaataaggataataaattattttaaatatgcagtattctattattttactgactattgcaaatgccactatcatattttgcaacttacacgacctatttgaaataccaccttctatacctttttgtcttttagaaattgtcggtcagatagtcaagagaggcagatgtcattaata

SEQ ID NO: 541 - DNA, 558 bp, Diabrotica virgifera
  misc_feature (1)..(558): RNAi target sequence
cgggggagtgattatctttgtaaaatggcacctacgaagccaaaagcagcggataaatccgcccccaagaaggaagaaaagaagaagcctgcggccgcaccagcagccggagccgctggagcttcttcctcaagttcaaaaacacccgccccagctccaaaagcagcagccaaagctgcaagcaaaccagctgacaagaaagcatcttcctcaaaaacccctgcacccgcacctaaagctgcctcagccaaaagctccgcgaaagcgcaagctgctgcccccaaaccaaaagccgctgctgctaaagctggaaaggctgcaggcaaaggtgctgccaaacccgcagccaaggctgcaggaaagaaaccagctgctgctggaaaggccaaggctcccgcaactcttattgctaagcccaagaagaatgttcctgttaaacaacaacagaaaggtgttggcaaaaagccagctgccagtgcagtgcaagtagcgagagcacttaaaatccaaaagaaagtaattaaaggccccaatggaacacactcaaggaaaatccgt

SEQ ID NO: 542 - DNA, 22 bp, Artificial Sequence
  primer
  misc_feature (1)..(22): forward primer
cgggggagtgattatctttgta

SEQ ID NO: 543 - DNA, 22 bp, Artificial Sequence
  primer
  misc_feature (1)..(22): reverse primer
acggattttccttgagtgtgtt

SEQ ID NO: 544 - DNA, 1017 bp, Diabrotica virgifera
  misc_feature (1)..(1017): WCRW transcript ta00525.004_diavv
gacgcttaggggaggggccttttagtgattatctttgtaaaatggcacctacgaagccaaaagcagcggataaatccgcccccaagaaggaagaaaagaagaagcctgcggccgcaccagcagccggagccgctggagcttcttcctcaagttcaaaaacacccgccccagctccaaaagcagcagccaaagctgcaagcaaaccagctgacaagaaagcatcttcctcaaaaacccctgcacccgcacctaaagctgcctcagccaaaagctccgcgaaagcgcaagctgctgcccccaaaccaaaagccgctgctgctaaagctggaaaggctgcaggcaaaggtgctgccaaacccgcagccaaggctgcaggaaagaaaccagctgctgctggaaaggccaaggctcccgcaactcttattgctaagcccaagaagaatgttcctgttaaacaacaacagaaaggtgttggcaaaaagccagctgccagtgcagtgcaagtagcgagagcacttaaaatccaaaagaaagtaattaaaggccccaatggaacacactcaaggaaaatccgtaactcagtccacttccgtcgtcctaagaccctcagaccacccaggagtcccaaataccccaagaggagtgttccccacagatcccgcatggatgcttacaatatcatcaaattcccattgaccaccgaagcagccatgaagaagattgaagataacaacacgttggtatttttagtacacactagggcaaacaagcaccacattaaagctgcagttaagaaattgtatgatatcaatgtagccaaggtcaacaccttaattaggcccgatggcaaaaagaaggcatatgtaaggttagctagagattatgatgctctagatgttgccaacaagattggcatcatataaattaatatcttaccttgttttattttttttgacatctaataaataagttgagaataaagttttttagtttgagttaaaaaaaaaaaaaatgcga

SEQ ID NO: 545 - DNA, 544 bp, Diabrotica virgifera
  misc_feature (1)..(544): RNAi target sequence
atgcgtgttgaggtcttttcttttcccaaaacttgacaaaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcagggccccaactggcaataaaactgtattgctacaaggcagacgtaatgcccgtgaagctgtgaaacactttggtcctgctcctggtgtaccacacagtcatgctaagccattggtaca

SEQ ID NO: 546 - DNA, 22 bp, Artificial Sequence
  primer
  misc_feature (1)..(22): forward primer
atgcgtgttgaggtcttttctt

SEQ ID NO: 547 - DNA, 22 bp, Artificial Sequence
  primer
  misc_feature (1)..(22): reverse primer
tgtaccaatggcttagcatgac

SEQ ID NO: 548 - DNA, 793 bp, Diabrotica virgifera
  misc_feature (1)..(793): WCRW transcript ta05162.001_diavv
ggctgtcgggggctggggggctaaccaaaattatacacatgcgtgttgaggtcttttcttttcccaaaacttgacaaaaatgggtatcgacatcaaccataaatacgaccgtaaggttaggagaacagaacctagaagtcaagatgtatatttacgtcttttagtaaaactgtaccgttatttagcccgtcgtacaggggccaaattcaataaaataatcctgaaaagattgtttatgagcaaaatcaacagaccaccactatctttatccaagttagtgcgtttgatgaagaagcctggccgtgatggacttattgctgtcgtagtaggaacaattactgatgatgctaggatttttgaaattcccaaattgtctgtatgtgcccttcgcgtgacacaaactgctagggccaggatcttgaaagctggaggtgaagtcatcaccttcgaccaattggcactcagggccccaactggcaataaaactgtattgctacaaggcagacgtaatgcccgtgaagctgtgaaacactttggtcctgctcctggtgtaccacacagtcatgctaagccattggtacattccaagggacgcaaatttgagagagcacgaggtcgtaggcgctcatgtggttacaagaaatagacttaagttaatcattttgtttctgctgtattcatatttgttgttcaataaataggaattgcagtacattggaattttgttttgtattttatagaatataacaaaataaaggaatttaatataaaaaaaaaaaaaaaaaaaaaaaaa

SEQ ID NO: 549 - DNA, 401 bp, Diabrotica virgifera
  misc_feature (1)..(401): RNAi target sequence
aaagaaaccgaaggcagagaaaaaggcaccaaaggagggtgcaactccaagtgataaaccctccgttaaaagacgtcctttcaaaagacatggacgtttatatgctaaagccatcttcacaggttacaaaagaggtcttcgtaatcaacacgaaaatacagccctattatctgtagaaggaaccagatcaaaagatgagagttggttttacgtaggaaagaaatgcgtctatgtatacaaagcaaaaaacaggacatgtgttcccggtaggcccaaatctgtcaaatccaaagttagggctatttggggaaaagtcaccagaccacatggcacaaggggtgcagtgagagccaaattcaataggaatttaccagccaaggctatgggacatcgtattcgta

SEQ ID NO: 550 - DNA, 21 bp, Artificial Sequence
  primer
  misc_feature (1)..(21): forward primer
aaagaaaccgaaggcagagaa

SEQ ID NO: 551 - DNA, 22 bp, Artificial Sequence
  primer
  misc_feature (1)..(22): reverse primer
tacgaatacgatgtcccatagc

SEQ ID NO: 552 - DNA, 1008 bp, Diabrotica virgifera
  misc_feature (1)..(1008): WCRW transcript ta00344.005_diavv
ccgattttttttttttttttttgtgttggaaaacgtattttttatttcttatttatatttataaaaacaactatatcttagatgggtacagcataatacgaatacgatgtcccatagccttggctggtaaattcctattgaatttggctctcactgcaccccttgtgccatgtggtctggtgacttttccccaaatagccctaactttggatttgacagatttgggcctaccgggaacacatgtcctgttttttgctttgtatacatagacgcatttctttcctacgtaaaaccaactctcatcttttgatctggttccttctacagataatagggctgtattttcgtgttgattacgaagacctcttttgtaacctgtgaagatggctttagcatataaacgtccatgtcttttgaaaggacgtcttttaacggagggtttatcacttggagttgcaccctcctttggtgcctttttctctgccttcggtttctttgccgctgcgtctgccattccgaagatctcgtttagaattaaaaagaagttatttcatttttctcctccaagtgataaaccctccgttaaaagacgtcctttcaaaagacatggacgtttatatgctaaagccatcttcacaggttacaaaagaggtcttcgtaatcaacacgaaaatacagccctattatctgtagaaggaaccagatcaaaagatgagagttggttttacgtaggaaagaaatgcgtctatgtatacaaagcaaaaaacaggacatgtgttcccggtaggcccaaatctgtcaaatccaaagttagggctatttggggaaaagtcaccagaccacatggcacaaggggtgcagtgagagccaaattcaataggaatttaccagccaaggctatgggacatcgtattcgtattatgctgtacccatctaagatatagttgtttttataaatataaataagaaataaaaaatacgttttccaacaaaaaaaaaaaaaaaaaa

SEQ ID NO: 553 - DNA, 542 bp, Diabrotica virgifera
  misc_feature (1)..(542): RNAi target sequence
aatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtccactaggtttgtctcccaaaaaagttggtgacgatattgccaaaggcactgctgactggaaaggtcttaaaatcacagttcagttgaaaatccaaaatcgtcaagctaccatttctgtagtcccatctgcctcctccctgatcattagggctcttaaagaaccaccacgcgataggaagaagcaaaagaacattaaacacactggtaacattactttcgatgaaatcatcgctattgccagacagatgaggcccaggtcaatggccaaacagttatccggaactgtaaaagaggttttaggaacagcccaatcagttggatgtacaattgatggtaaagcagcacatgatgttattgacgaggttaatgaaggaacc

SEQ ID NO: 554 - DNA, 23 bp, Artificial Sequence
  primer
  misc_feature (1)..(23): forward primer
aatctgtaaacatcggcgtagaa

SEQ ID NO: 555 - DNA, 21 bp, Artificial Sequence
  primer
  misc_feature (1)..(21): reverse primer
gttccttcattaacctcgtca

SEQ ID NO: 556 - DNA, 768 bp, Diabrotica virgifera
  misc_feature (1)..(768): WCRW transcript ta01789.001_diavv
ggaagatgattgaccatgtcaattgtcacgtcatgtgtcaggggtccttttcgaatttaccattgtgaaaatattttcactattgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataaactattattagaatattttttctaagttatcagttgttttatttaacctttatccaaatgtggcattttttaatttgttaagaatgtaattgatggattcgaccgttacttgatgg

SEQ ID NO: 557 - DNA, 450 bp, Diabrotica virgifera
  misc_feature (1)..(450): RNAi target sequence
  misc_feature (341)..(341): n can be any nucleotide
  misc_feature (413)..(413): n can be any nucleotide
  misc_feature (426)..(426): n can be any nucleotide
aggcatttcaaaaacaaccaaccgtttttctcaaccgcaaaagtggaggaaagaaaaatttaagacattctcgcagtgtagggctcggttttaaaactcccagagaggcaattgaaggttcttgcattgacaagaaatgtcccttcactggaaatgtatcaatccgtggccgtattctcactggagttgtccaaaaaatgaagatgcaaaggactattgtcatccgtagagattatttgcattatatcaggaaatacaatcgttttgaaaagaggcataggaatatgtctgtacatttatcaccctgcttcagggatgtggaaattggagatgtagttacnattggtgaatgcagaccactttcaaaaacagttagattcaacgtattgaaagtaactaaaggtagcagttcnaagaagagcttcnggaagttttgagtgatgaaacatt

SEQ ID NO: 558 - DNA, 22 bp, Artificial Sequence
  primer
  misc_feature (1)..(22): forward primer
aggcatttcaaaaacaaccaac

SEQ ID NO: 559 - DNA, 24 bp, Artificial Sequence
  primer
  misc_feature (1)..(24): reverse primer
aatgtttcatcactcaaaacttcc

SEQ ID NO: 560 - DNA, 615 bp, Diabrotica virgifera
  misc_feature (1)..(615): WCRW transcript ta02086.002_diavv
cttgtcaatgtaagaaccttcaattgcctctctgggagttttaaaaccgagccctacactgcgagaaggtcataaaggggaatcctttcttttactagtgaaaatggcggatcagaccgaaaaggcatttcaaaaacaaccaaccgtttttctcaaccgcaaaagtggaggaaagaaaaatttaagacattctcgcagtgtagggctcggttttaaaactcccagagaggcaattgaaggttcttacattgacaagaaatgtcccttcactggaaatgtatcaatccgtggccgtattctcactggagttgtccaaaaaatgaagatgcaaaggactattgtcatccgtagagattatttgcattatatcaggaaatacaatcgttttgaaaagaggcataggaatatgtctgtacatttatcaccctgcttcagggatgtggaaattggagatgtagttacaattggtgaatgcagaccactttcaaaaacagttagattcaacgtattgaaagtaactaaaggtagcagttcaaagaagagcttcaggaagttttgagtgatgaaacatttttaaaataaaaatcttataaaatgaaaaaaaaaaaaaaaaaa

SEQ ID NO: 561 - DNA, 225 bp, Diabrotica virgifera
  misc_feature (1)..(225): RNAi target sequence DV-HP2-FRAG1
gaaacgacaaggaggaaagttgtgtcttgcggagtactagaaacaccgagattcggacgaaagagtactttcctgttcgtgcccggtacgaaggttacctatgaatgcatccaagagttcgtgttggtaggtgatcagcggagagagtgtcaagcggatggaacatggaatattcctgaatacggatacacatattgcttacgtcagcaggaatactctcaacga

SEQ ID NO: 562 - DNA, 212 bp, Diabrotica virgifera
  misc_feature (1)..(212): RNAi target sequence DV-HP2-FRAG2
gagcattgttccacagggaattcggaaggacttcagcgacttacaacaacaaaacgttcaagcctcaattcctaatgaatccggaagatttcctaccaaccaacagatctacagatcttaagcgaatatccgaaatatgtcctctaaagttgtacgaatgttactacgattacgctatgacggttgacagggatttggcgcattacaccaag

SEQ ID NO: 563 - DNA, 210 bp, Diabrotica virgifera
  misc_feature (1)..(210): RNAi target sequence DV-HP2-FRAG3
cttgggagaagcagaatttgaccacaaacgacaacgctaacatccgaatttctctctggggttacagagaaacgactatgaaaccagtgtttgtttatatcaccgatatcgctgataatgttcaaaacattggagaacacacgattgttccttctcagtttagaactagagtcaatcaatatctgactgatattaagtttggattcctcc

SEQ ID NO: 564 - DNA, 229 bp, Diabrotica virgifera
  misc_feature (1)..(229): RNAi target sequence DV-HP2-FRAG4
aatggaaagggagaattcgcattggtgaaatcagttacgcaaacggacaatctggaaatccaaggaagatttgagcaaatggaccctaacacttatggtgaggttagagctactcagctgacttctgtagtagctaaaggtaataacacaatagcaattgaagtcagaaggagacctctggattctagatggagatataggttggatgttatagcagataatagaagac

SEQ ID NO: 565 - DNA, 170 bp, Diabrotica virgifera
  misc_feature (1)..(170): RNAi target sequence DV-HP2-FRAG5
gaaacgacaaggaggaaagttgtgtcttgcggagtactagaaacaccgagattcggacgaaagagtactttcctgttcgtgcccggtacgaaggttacctatgaatgcatccaagagttcgtgttggtaggtgatcagcggagagagtgtcaagcggatggaacatggaa

SEQ ID NO: 566 - DNA, 233 bp, Diabrotica virgifera
  misc_feature (1)..(233): RNAi target sequence DV-HP2-FRAG6
gaaacgacaaggaggaaagttgtgtcttgcggagtactagaaacaccgagattcggacgaaagagtactttcctgttcgtgcccggtacgaaggttacctatgaatgcatccaagagttcgtgttggtaggtgatcagcggagagagtgtcaagcggatggaacatggaatattcctgaatacggatacacatattgcttacgtcagcaggaatactctcaacgacaagctgg

SEQ ID NO: 567 - DNA, 162 bp, Diabrotica virgifera
  misc_feature (1)..(162): RNAi target sequence DV-HP2-FRAG7
tttgttatttttgttttgtttagtgttagcgttaaaggactagatggtgatcttccaccagatgtcgaaactatcgatgtggagactacgaatgtaagtaacgcggatccagacgcagggaaacctattccggtggaagatacgcctaatggagtccctcca

SEQ ID NO: 568 - DNA, 473 bp, Diabrotica virgifera
  misc_feature (1)..(473): RNAi target sequence DV-HP2-FRAG8
gtgaatacaaactatgaagtagataaatccttagttaatgtaaccaatagtttggtaaatgtgactaaaaatcccagacggacttatcagacagttaataaaatgggcaaatattcgacattttatgctgcagattacgatcctatgacctcagacacagctccaccagacactgaccaacgaggaggaggaggaactccatacactatatcagaaccgagactggcagaaataaggaaacattttatgtacccatttttcgataaaggaggcagtgataataacttgggagatttccaaaaggacattcaatcttccattcctcaggtgcacaagaatttaaacttccagttgcctttctttggattcaggtataattacacaagagtttcagtgaatgggtatctggaattcagcgatccacctccaaattatgactatccattagtatttccaattaaagaatggcccaa

SEQ ID NO: 569 - DNA, 430 bp, Diabrotica virgifera
  misc_feature (1)..(430): RNAi target sequence DV-HP2-FRAG9
aaagaatgatcctgcctttattggcattttcttcagcagatgcagaatcggtaatctacgtgatggagacattgatcaaagaacacccggggtctattttagaatggaaagagatttaagaacgaggcaagacagaatgggtgtagaaattagagaaagacttaagtgggatatcagaacaggagtcattggatcagaaacattcgatcctaagcacgccgttattgtcacttggaaaaatgttactttcactggaggattcgctaatgctaaatacaagacaaacaccttccaaatggttcttgcaactgacgaagtcttcacttacgcgatgttcaactacctcaacttggactggacctcccacactgaagcgggtggtgattcccaaaacggggaaggtggtgtcagtgcctatgttggttttaac

SEQ ID NO: 570 - DNA, 486 bp, Diabrotica virgifera
  misc_feature (1)..(486): RNAi target sequence DV-HP2-FRAG10
ccagaagctacgaatacaatccttacagtcaagcttccgtcattcgagatctcacatcagttggatttggaaatggttttaagggaagacatattttccgtatagacgaagacattttgcttggatcgtgcaacaaagatatagatggtgccaaccttcccctgaaattcgctcctgaaagtggtaacatgttgggtggaacagtggtaaatataactggtccatgcttcaatttgaatgataggattcgatgcaagtttgacgtatcaaatgaagtatttgggtatgttgttgataaaaacagagctatctgtgtacaacctcaactttatgccgaaggatgggtgaatcttcaaattgctgttaattccgaagcattcaagtggaaggggaagtattatgtagaatcacctgctagtgcgactcaaaaaatcttctttaaggacatgaaattacacgaaaaatctccgagcgaattaaaaatca

SEQ ID NO: 571 - DNA, 500 bp, Diabrotica virgifera
  misc_feature (1)..(500): RNAi target sequence DV-HP2-FRAG11
aaattaatttaactgagtctatcacagttaatacatatactacaagccagagcagcatagaattaacaccggtaatatggagccgacccattccactcggttggtacttccagttccaatgggaaaaccagtacggtaaaaattggcccaaatatctatgtgacgattggctgagaacggacagatatctaaaaaacttcgcccacgaacttgctcaatgtccctgcaccgtcgaacaggctttagctgacaagggcaggtttatgccagacttcgattgcgacaaagattcgaacccgatttgttactataacaaccaagcacttcattgtgtgaaaactggatctcccactttagaaggctccgaacaacaatgttgctatgataaaaacggctttttgatgctctcttacgatcagcaatggggttctagtccgagacgttgccacaacttgggtaaaatgccttacaatgaagcgacaaaagtgcctactctctca

SEQ ID NO: 572 - DNA, 310 bp, Diabrotica virgifera
  misc_feature (1)..(310): RNAi target sequence DV-HP2-FRAG12
ggtgttactatttacactccaagctacatccttaatcaatcagaagtcatcattatgtttgacaatggagctggaatggaggttgtcgacaatcaaggattcatgagtgcaagagtatttttgccttggtcgtttataaataaaaccataggcctttttggaaattggagttttaacaaagaagatgacttcacacttccagatggttctagagcagcaatagtgaataacataaatgacatggaaagggtttacaatgattttggttccaaatggatgttggaggatgtgttagatcctcaaaagggta

SEQ ID NO: 573 - DNA, 1327 bp, Diabrotica virgifera
  misc_feature (1)..(1327): RNAi target sequence DV-RYANR-FIS
ggggataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgctggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaataactttcatcgtaatataaatatatttatttaggttatatactttactttaagcagctcaagtataccgtgacatcccactcatacatcaatgtctataattgtttcatgacaaatcatttaatagtattttaaagcattcattcgttcaacaccttttttacatttttcaagtattatatcaatctttttaaagaattgtttggctattaaccggattcaatccatatagttccgtaaaataattatgcgttttaataattaatgtaattaaaaatagttagtatatttttgaaataaaacaactgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttacatttttcatgaaaattcaattcacattattttcctcccgttctcttcatattatatttatttattctttaatatagttttgggcgtgaagcccagtaaatacctatatgaagtatattgatggaactgccatgcttgatgggttttgtctgcaattaaaataaaaccaaaacaaacatttgtacagtattgtaaaattcacaatatttaggtagatgtttaaaatttaatattttttaagagtttgcatttatgttaatcgtagttaagtttttataaaaatttagtagttgtgagaaataaaataagtaaaagagaaa

SEQ ID NO: 574 - DNA, 193 bp, Diabrotica virgifera
  misc_feature (1)..(193): RNAi target sequence DV-RYANR-FRAG1
tttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtag

SEQ ID NO: 575 - DNA, 145 bp, Diabrotica virgifera
  misc_feature (1)..(145): RNAi target sequence DV-RYANR-FRAG2
acgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaag

SEQ ID NO: 576 - DNA, 83 bp, Diabrotica virgifera
  misc_feature (1)..(83): RNAi target sequence DV-RYANR-FRAG3
accattgtcctgaaattgctgaagttggtgatcaatttgatatgtctcatcttgtaccgaaccggatatcaaggctacttctt

SEQ ID NO: 577 - DNA, 292 bp, Diabrotica virgifera
  misc_feature (1)..(292): RNAi target sequence DV-RYANR-FRAG4
atttatgatttacacattcgtctcgctgatcagcctttgcttcgctagtggagatcacaaaacgacattcactgatattctgatgaatatagtagggatttttatgtggatagctgctggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaa

SEQ ID NO: 578 - DNA, 502 bp, Diabrotica virgifera
  misc_feature (1)..(502): RNAi target sequence DV-RYANR-FRAG5
ataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgctggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaa

SEQ ID NO: 579 - DNA, 199 bp, Diabrotica virgifera
  misc_feature (1)..(199): RNAi target sequence DV-RYANR-FRAG6
gcagctcaagtataccgtgacatcccactcatacatcaatgtctataattgtttcatgacaaatcatttaatagtattttaaagcattcattcgttcaacaccttttttacatttttcaagtattatatcaatctttttaaagaattgtttggctattaaccggattcaatccatatagttccgtaaaataattatgcg

SEQ ID NO: 580 - DNA, 197 bp, Diabrotica virgifera
  misc_feature (1)..(197): RNAi target sequence DV-RYANR-FRAG7
ctgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttac

SEQ ID NO: 581 - DNA, 142 bp, Diabrotica virgifera
  misc_feature (1)..(142): RNAi target sequence DV-RYANR-FRAG8
gatttatgatttacacattcgtctcgctgatcagcctttgcttcgctagtggagatcacaaaacgacattcactgatattctgatgaatatagtagggatttttatgtggatagctgctggagctacagctcttcattattg

SEQ ID NO: 582 - DNA, 129 bp, Diabrotica virgifera
  misc_feature (1)..(129): RNAi target sequence DV-RYANR-FRAG9
cacattcgtctcgctgatcagcctttgcttcgctagtggagatcacaaaacgacattcactgatattctgatgaatatagtagggatttttatgtggatagctgctggagctacagctcttcattattg

SEQ ID NO: 583 - DNA, 152 bp, Diabrotica virgifera
  misc_feature (1)..(152): RNAi target sequence DV-RYANR-FRAG10
ggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaa

SEQ ID NO: 584 - DNA, 587 bp, Diabrotica virgifera; identical to SEQ ID NO: 85
  misc_feature (1)..(587): RNAi target sequence DV-RYANR-RASRHO-FIS

SEQ ID NO: 585 - DNA, 163 bp, Diabrotica virgifera
  misc_feature (1)..(163): RNAi target sequence DV-RYANR-RASRHO-FRAG1
aagacggaagatccatggcagagaaaatcaatgcttttgcatatctagaatgttctgccaaaagtaaggagggtgtaagagaggtttttgaaaatgctacccgagctgcactgcaagtcaaaaagaagaagaagccccgttgtgtaatgttttgagccactac

SEQ ID NO: 586 - DNA, 178 bp, Diabrotica virgifera
  misc_feature (1)..(178): RNAi target sequence DV-DEAD-FRAG1
gaggattctagtagccacaaacttatttggacgtggaatggatatcgaaagagtgaacatcgtcttcaactatgacatgcccgaagattctgacacttacctgcacagagtagcccgagctggacgtttcggtaccaaaggtctagccattactttcgtatcagaagagggagatgcc

SEQ ID NO: 587 - DNA, 152 bp, Diabrotica virgifera
  misc_feature (1)..(152): RNAi target sequence DV-HPP15-FRAG1
ggacaactgaccttcatcactcaagtgactggcagtgtaaaataccaagagaaaacaccaaaaacctttcagcgaaacttcataattacagcacagggcgataaatggaaaattgtcagtgattgtatgaggctgcaagaaccattaaacgc

SEQ ID NO: 588 - DNA, 402 bp, Diabrotica virgifera
  misc_feature (1)..(402): RNAi target sequence DV-HPP15-BPSAR2-FRAG1
ttccattggtaacatgaggtttacgacgttcgatttggggggccacgagcaggctaggagagtgtggagggactactttccagcagtcgatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaatgatctacccggtaggcctctagaactatttatgtgctctatactcaaaagacaaggttatggagaaggtttccgttggttggcacaatatatcga

SEQ ID NO: 589 - DNA, 171 bp, Diabrotica virgifera
  misc_feature (1)..(171): RNAi target sequence DV-HPP15-BPSAR2-FRAG2
ccattggtaacatgaggtttacgacgttcgatttggggggccacgagcaggctaggagagtgtggagggactactttccagcagtcgatgccatagtgttccttgttgatgccaacgacagctcaagatttgtagaaagccaggaacagctaaatgccctcctctcagacg

SEQ ID NO: 590 - DNA, 137 bp, Diabrotica virgifera
  misc_feature (1)..(137): RNAi target sequence DV-HPP15-BPSAR2-FRAG3
ttgatctcccaggtgctgcttcggaagatgaattacgaactagattcggcttgtttggccaaaccacaggcaaaggcaaagtagccagaaatgatctacccggtaggcctctagaactatttatgtgctctatactc

SEQ ID NO: 591 - DNA, 135 bp, Diabrotica virgifera
  misc_feature (1)..(135): RNAi target sequence DV-HPP15-BPSAR2-FRAG4
ggccacgagcaggctaggagagtgtggagggactactttccagcagtcgatgccatagtgttccttgttgatgccaacgacagctcaagatttgtagaaagccaggaacagctaaatgccctcctctcagacgaa

SEQ ID NO: 592 - DNA, 294 bp, Diabrotica virgifera
  misc_feature (1)..(294): RNAi target sequence DV-HPP15-BPSAR2-FRAG5
ctttataatttgtcgttgaaaaagatagggctccaaagtcctattgccaacaaaaaaacaacgcaagacattaaacaacttttttcaagcccatctgtatttaaaaaaacagtgcaaaatgtttctgtgggactggtttacgggaatgctgggatatctaggattgtggaagaaacctggaaaactattattcttaggactggataacgcaggcaaaactacccttctacatatgctcaaggatgacagactggcccagcatcttcccacgttacatcccacatcagaggagct

SEQ ID NO: 593 - DNA, 407 bp, Diabrotica virgifera
  misc_feature (1)..(407): RNAi target sequence DV-HPP15-BPSAR2-FRAG6
ttaattatgtatttttccatttcgttctgtcattgagttaggatattaatgtttgaggaactattggcaacactgcaactacctgattcatttcagatcttaggtactttacataaatatctaaatatagatgttggcaatgtaattttgaacaacagtatatacattcaatgtaaattatatatttttagttaagttaccttcttaaatggtgtttgagtggctatggtactgaaatagtttgactttttgtgttcttcgataactaaaaatgatttcttgtggaaagttacactcagaattacatagttaacttctttatcagcagttgttgtcaagatttccattttgagacgattgttttgtaaattaggtgggaatttttaaaatgttggactgttttttaa

SEQ ID NO: 594 - DNA, 168 bp, Diabrotica virgifera
  misc_feature (1)..(168): RNAi target sequence DV-HP1-FRAG1
ggggaaggtaaatcagtattcacttgatcttcaaggtagattaacgcaagtagaaatctaaaacatgtctggacgtggtaagggaggcaaagttaagggaaaagcaaagtcccgatcaaatcgtgctggtttacaatttcctgtaggtcgtattcatcgtttattgag

SEQ ID NO: 595 - DNA, 190 bp, Diabrotica virgifera
  misc_feature (1)..(190): RNAi target sequence DV-HP1-FRAG2
ggggaaggtaaatcagtattcacttgatcttcaaggtagattaacgcaagtagaaatctaaaacatgtctggacgtggtaagggaggcaaagttaagggaaaagcaaagtcccgatcaaatcgtgctggtttacaatttcctgtaggtcgtattcatcgtttattgagaaaaggaaattatgccgaaaga

SEQ ID NO: 596 - DNA, 159 bp, Diabrotica virgifera
  misc_feature (1)..(159): RNAi target sequence DV-HP1-FRAG3
ttggaattggcaggaaatgcagctagagataacaaaaagacccgtataattcctagacatttacaattggccataagaaatgacgaggaattgaacaaattactgtcaggagttaccatcgcccaaggtggagtattgcctaatatacaagcagtactt

SEQ ID NO: 597 - DNA, 196 bp, Diabrotica virgifera
  misc_feature (1)..(196): RNAi target sequence DV-RNAPOL-FRAG1
ctgttttaaagccatggctgatgaagaatttgacgaaaatgatgtagcagatgatttcgatgacgacgtagaggatgataatatcgaagaactcgaacaacccgaggaagatggagataacatcgatatccttgctccaggacaagcaggaggtggtgtaccaaaaaacaagaggataacaactaaatatatgacc

SEQ ID NO: 598 - DNA, 163 bp, Diabrotica virgifera
  misc_feature (1)..(163): RNAi target sequence DV-CPNN-FRAG1
ctgttggtgctacttgtcttccacgcctaacagctcccacatctcaagaacttggttacgcagatattgtatgtgtagaagaattgggtgatacccctatagtttctttcagattggagggcaaagaatcaagaatttccacaattgtcatcagaggtgctac

SEQ ID NO: 599 - DNA, 236 bp, Diabrotica virgifera
  misc_feature (1)..(236): RNAi target sequence DV-CPNN-FRAG2
cagccaaactcatgatactaggaagtcaaatgcaagattctgaggtgggtgatggaactaactttgtgattatacttgctggagcacttttggagcatgctgaagaactaattcgtcttggagtaactcccacagaaatagcagaaggttatgagaaagcactagacaaatgtctagaaatccttcctaatcttatttgctacacaatcaaggatttcagaaacatcgaagaagtc

SEQ ID NO: 600 - DNA, 149 bp, Diabrotica virgifera
  misc_feature (1)..(149): RNAi target sequence DV-CPNN-FRAG3
ttggagcatgctgaagaactaattcgtcttggagtaactcccacagaaatagcagaaggttatgagaaagcactagacaaatgtctagaaatccttcctaatcttatttgctacacaatcaaggatttcagaaacatcgaagaagtcaa

SEQ ID NO: 601 - DNA, 194 bp, Diabrotica virgifera
  misc_feature (1)..(194): RNAi target sequence DV-CPNN-FRAG4
ctgcagatgaacttatgaactttagtaggggagaagaaaatcttcttgaattacaaatcaaatgtatagcagatgctggagctaaagttgtagttgcaggagccaaatttggagatatggctctacattacttacataaatatggcatgatggttgtcaggttgaactccaaatttgatttgagaagattatgc

SEQ ID NO: 602 - DNA, 785 bp, Diabrotica virgifera
  misc_feature (1)..(785): RNAi target sequence DV-TEF2-FRAG1
tctggtaacatctgtggtttggttggtgttgatcaattcttggttaagactggtaccattaccactttcaaggatgcccacaacttgaaggtcatgaaattcagtgtatctcctgtagtacgtgttgctgttgaacctaagaaccctgctgatttgccaaaacttgtagaaggtttgaaacgtttgaccaaatccgatcctatggtccaatgtatcattgaagaatctggtgagcacatcattgctggtgccggagaattgcatcttgaaatttgccttaaggatcttgaagaagatcatgcctgcattcccattaagaaatctgaccctgttgtatcctaccgtgagacagtaagtgaagagtctgatcagatgtgcctctcaaaatcacccaacaaacacaacagattgttcatgaaagcttgtcctatgcctgatggacttgctgaagatattgatgatggtaaagttaacccacgtgatgacttcaaagtccgtgcccgttatcttactgagaaatatgactatgatataactgaagcccgtaagatctggtgctttggacctgatggtactggacccaacatccttgttgattgtactaagggagtgcaatatcttaatgaaatcaaagactctgtggtagctggtttccaatgggcaaccaaagaaggtgtcttgtctgaagaaaacttgagaggtgttagattcaacatttatgatgttaccttacacgctgatgctatccatcgtggaggtggtcaaatcattccaacaacccgtag

SEQ ID NO: 603 - DNA, 144 bp, Diabrotica virgifera
  misc_feature (1)..(144): RNAi target sequence DV-SRP54-FRAG1
tgggaggcatcaaaggtctcttcaaaggtggcgatatggctaaaaacgtcaaccacaaccagatggcgaaacttaatcaacaaatggccaaaatgatggaccctagagtcctccaacaaatgggcggcatggcaggtttgcaaa

SEQ ID NO: 604 - DNA, 364 bp, Diabrotica virgifera
  misc_feature (1)..(364): RNAi target sequence DV-SRP54-FRAG2
acgagttggacaacagggatggcgcaaaattgtttactaaacaagttggtagagtggtcagggtagcacaaggatctggtgtaacagaaagagaagtaaaagatctcattacgcagtacacaaaattcgcagcggtggtaaagaaaatgggaggcatcaaaggtctcttcaaaggtggcgatatggctaaaaacgtcaaccacaaccagatggcgaaacttaatcaacaaatggccaaaatgatggaccctagagtcctccaacaaatgggcggcatggcaggtttgcaaaatatgatgagacaactccaagcaggcgcagctggtggtttagggggcttaggtaatcttatggggggctttgg

SEQ ID NO: 605 - DNA, 226 bp, Diabrotica virgifera
  misc_feature (1)..(226): RNAi target sequence DV-SRP54-FRAG3
gtagcacaaggatctggtgtaacagaaagagaagtaaaagatctcattacgcagtacacaaaattcgcagcggtggtaaagaaaatgggaggcatcaaaggtctcttcaaaggtggcgatatggctaaaaacgtcaaccacaaccagatggcgaaacttaatcaacaaatggccaaaatgatggaccctagagtcctccaacaaatgggcggcatggcaggtttgc

SEQ ID NO: 606 - DNA, 163 bp, Diabrotica virgifera
  misc_feature (1)..(163): RNAi target sequence DV-SRP54-FRAG4
ttatcagaaaaagaactggaaatcatgtttggtatgtgcagatacattcagagctggtgcctacgatcaggtaaaacagaactgtacaaaagctaggatacccttttatggaagttacacagaagttgatcctgtagtcatagcccaggatggtgttgatatg

SEQ ID NO: 607 - DNA, 171 bp, Diabrotica virgifera
  misc_feature (1)..(171): RNAi target sequence DV-TIF3-FRAG1
gttgagtgctgtttctggagaagatgcccaagaccgttcagatcgtacaattcttactccgtgggttaagttcctttgggaatcttactgtcaatgtttggaacttttgcgtacaaatgcacatgttgagaacttgtatcatgatatagccaggatggctttccagttttg

SEQ ID NO: 608 - DNA, 232 bp, Diabrotica virgifera
  misc_feature (1)..(232): RNAi target sequence DV-TIF3-FRAG2
atcgtggggatcgcagggacgatagggagaggagagacgacagggataacagggataggagagacgacagagatcgtagagatgatagggataggagagacgacagggagcgtagagatgatagagagagaagagatgaccgtggcggaagagatgataaccgggaccgccgagacgatcgtgatcgtagagacgacagggaccgaagaggcggggacgaaggtacttggcg

SEQ ID NO: 609 - DNA, 166 bp, Diabrotica virgifera
  misc_feature (1)..(166): RNAi target sequence DV-TIF3-FRAG3
ggcaaccgcgacagcggaagatttggcgacagagacagagaaggtggtgtcagattcacgagagataatcgggataatcgtggggatcgcagggacgatagggagaggagagacgacagggataacagggataggagagacgacagagatcgtagagatgataggg

SEQ ID NO: 610 - DNA, 239 bp, Diabrotica virgifera
  misc_feature (1)..(239): RNAi target sequence DV-TIF3-FRAG4
gcaagtccacaactacaagatttgtacaattggctggaagtggagttccatcctttactattgtgtcagagagtgcatgaggtaatcaaatctctcgaatctgaagaaaatgcagccctccaacaatatgtgccagctttacaagatgtaactctggtgcgtctagtgagacagatagcacaagtctatcagaccatagaatttgctaggttgatccagattgccaaatttactacacc

SEQ ID NO: 611 - DNA, 227 bp, Diabrotica virgifera
  misc_feature (1)..(227): RNAi target sequence DV-TIF3-FRAG5
ggttgattgtgtgagacacaatgatatgcaaattcgtattgatcatggcaaagactgtatccactttggaatggacctgagtgaaagccaaagagaggacaaaccagagggacccactttgcaagttatgcctagtgagcaagtcagaaatcaacttattaacatgtctactgtattgaatcaagccatacaagtcattaatcctaataagaagaagcttgaacgcg

SEQ ID NO: 612 - DNA, 224 bp, Diabrotica virgifera
  misc_feature (1)..(224): RNAi target sequence DV-TIF3-FRAG6
tgttataagagggtatttgcggatggcagaagaaagaacagagaatgctagagaacagtcagcacaagcagttattgatatcgatgatttagataatttggctacacctgaaagtatattgttgagtgctgtttctggagaagatgcccaagaccgttcagatcgtacaattcttactccgtgggttaagttcctttgggaatcttactgtcaatgtttggaac

SEQ ID NO: 613 - DNA, 154 bp, Diabrotica virgifera
  misc_feature (1)..(154): RNAi target sequence DV-TIF3-FRAG7
aagactgtatccactttggaatggacctgagtgaaagccaaagagaggacaaaccagagggacccactttgcaagttatgcctagtgagcaagtcagaaatcaacttattaacatgtctactgtattgaatcaagccatacaagtcattaatcc

SEQ ID NO: 614 - DNA, 742 bp, Diabrotica virgifera
  misc_feature (1)..(742): RNAi target sequence DV-TIF3-FRAG8
ctggcaagtccacaactacaagatttgtacaattggctggaagtggagttccatcctttactattgtgtcagagagtgcatgaggtaatcaaatctctcgaatctgaagaaaatgcagccctccaacaatatgtgccagctttacaagatgtaactctggtgcgtctagtgagacagatagcacaagtctatcagaccatagaatttgctaggttgatccagattgccaaatttactacaccttttcatctggagagacttttggttgattgtgtgagacacaatgatatgcaaattcgtattgatcatggcaaagactgtatccactttggaatggacctgagtgaaagccaaagagaggacaaaccagagggacccactttgcaagttatgcctagtgagcaagtcagaaatcaacttattaacatgtctactgtattgaatcaagccatacaagtcattaatcctaataagaagaagcttgaacgcgaaaaacttagagctgttatggttcagaattatcacgaaacaaaggttagagaacaccagaaaattttacaaagacacaagattattgaggacagaaaggaatatattgagcgtttgaatacagtcagggaagaagaggagcagaaaagattggaagaaatgcaacggcagcacttactggccgaacaaaaacgattggaccaagaaagagaagaaagagagcggaaacgtgctctaaatgaaatccagcagg

SEQ ID NO: 615 - DNA, 619 bp, Diabrotica virgifera
  misc_feature (1)..(619): RNAi target sequence DV-TIF3-FRAG9
ccaacaatatgtgccagctttacaagatgtaactctggtgcgtctagtgagacagatagcacaagtctatcagaccatagaatttgctaggttgatccagattgccaaatttactacaccttttcatctggagagacttttggttgattgtgtgagacacaatgatatgcaaattcgtattgatcatggcaaagactgtatccactttggaatggacctgagtgaaagccaaagagaggacaaaccagagggacccactttgcaagttatgcctagtgagcaagtcagaaatcaacttattaacatgtctactgtattgaatcaagccatacaagtcattaatcctaataagaagaagcttgaacgcgaaaaacttagagctgttatggttcagaattatcacgaaacaaaggttagagaacaccagaaaattttacaaagacacaagattattgaggacagaaaggaatatattgagcgtttgaatacagtcagggaagaagaggagcagaaaagattggaagaaatgcaacggcagcacttactggccgaacaaaaacgattggaccaagaaagagaagaaagagagcggaaacgtgctctaaatgaaatccagcag

SEQ ID NO: 616 - DNA, 713 bp, Diabrotica virgifera
  misc_feature (1)..(713): RNAi target sequence DV-EIF-4A-FRAG2
cgtctagcacatcgtttggcatggtagccgaaagtaaaattacctgtacgtcagtgttcaacattttgaacacgtcatgaatttgatctttaaaaccccttgacaacatttcatcggcttcatccaaaacaaacatttttatatgagtcggccttaaggctctccttgttatcatatcataaactctaccaggtgtaccaactacaacatgtacgccagtttcaagttttcttatgtcttctcgtacattggtaccaccaatacatgcatgacactgcgctgacatgaaatctcctagggcaattactactttttggatctgttgagccaattcacgagttggtgccaatataagagcttggcactccctcactgacgtgtcaatttgttgtaaaatagagatggagaatgttgcagtcttaccagtacctgactgagcctgagcaataacatcgtgtccctttacacaaggaatgatggctctctgttggatagcagaaggtttttcaaaaccataggcataaattcctcttaaaagttcctcttttaggttcatgtcgtcgaaattatcgaccacctcttcccagttggattcaataatgccatcaggctccatacctggtgggccgtcatagccttggggctggctgtcttcattagctgggccattcttgtcccactcttcacgacgatctggcatagacatgtctact

SEQ ID NO: 617 - DNA, 200 bp, Diabrotica virgifera
  misc_feature (1)..(200): RNAi target sequence DV-EIF-4A-FRAG3
tctatgccagatcgtcgtgaagagtgggacaagaatggcccagctaatgaagacagccagccccaaggctatgacggcccaccaggtatggagcctgatggcattattgaatccaactgggaagaggtggtcgataatttcgacgacatgaacctaaaagaggaacttttaagaggaatttatgcctatggttttgaaaa

SEQ ID NO: 618 - DNA, 270 bp, Diabrotica virgifera
  misc_feature (1)..(270): RNAi target sequence DV-PAT3-SS1
tcaacattgataaacacataggaatggcattttcaggcttaatagctgatgcaaggcaaatcgttgagattgctagaaaagaagcatcaaattatagacatcaatatggttcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccatctggagttagct

SEQ ID NO: 619 - DNA, 322 bp, Diabrotica virgifera
  misc_feature (1)..(322): RNAi target sequence DV-PAT3-FRAG5
ggggagtcgtcaacatcaatttcaagtttcaagaaaaagcaaatcactacgacttgccggattttgtagtagtgttaattttgtattaaaaaatcaaaatgagttctattggaactgggtacgatttatcagcttcccaattctctcctgatggaagagtatttcaagttgaatatgcaatgaaagcagttgaaaatagtggcaccgtaataggcctccgaggtacagatggcattgtattggctgctgaaaagctcattatgtcaaaattgcatgaaccaagtacaaataaacgaattttcaacattgataaacacatagg

SEQ ID NO: 620 - DNA, 322 bp, Diabrotica virgifera
  misc_feature (1)..(322): RNAi target sequence DV-PAT3-FRAG6
aatggcattttcaggcttaatagctgatgcaaggcaaatcgttgagattgctagaaaagaagcatcaaattatagacatcaatatggttcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccatctggagttagctatggatactttggatgtgctacaggtaaagcaaaacagtctgcaaagactgaaatagaaaaattgaagatgggg

SEQ ID NO: 621 - DNA, 161 bp, Diabrotica virgifera
  misc_feature (1)..(161): RNAi target sequence DV-PAT3-FRAG7
ggggagtcgtcaacatcaatttcaagtttcaagaaaaagcaaatcactacgacttgccggattttgtagtagtgttaattttgtattaaaaaatcaaaatgagttctattggaactgggtacgatttatcagcttcccaattctctcctgatggaagagta

SEQ ID NO: 622 - DNA, 161 bp, Diabrotica virgifera
  misc_feature (1)..(161): RNAi target sequence DV-PAT3-FRAG8
tttcaagttgaatatgcaatgaaagcagttgaaaatagtggcaccgtaataggcctccgaggtacagatggcattgtattggctgctgaaaagctcattatgtcaaaattgcatgaaccaagtacaaataaacgaattttcaacattgataaacacatagg

SEQ ID NO: 623 - DNA, 161 bp, Diabrotica virgifera
  misc_feature (1)..(161): RNAi target sequence DV-PAT3-FRAG9
aatggcattttcaggcttaatagctgatgcaaggcaaatcgttgagattgctagaaaagaagcatcaaattatagacatcaatatggttcaaatattcctcttaaatacctaaatgatagagtaagcatgtacatgcatgcatacactttatacagtgctg

SEQ ID NO: 624 - DNA, 161 bp, Diabrotica virgifera
  misc_feature (1)..(161): RNAi target sequence DV-PAT3-FRAG10
ttagaccatttggttgcagtgtcatcttggccagttatgaagatagtgacccatctatgtatctgattgatccatctggagttagctatggatactttggatgtgctacaggtaaagcaaaacagtctgcaaagactgaaatagaaaaattgaagatgggg

SEQ ID NO: 625 - DNA, 162 bp, Diabrotica virgifera
  misc_feature (1)..(162): RNAi target sequence DV-PAT3-FRAG11
ttgtattaaaaaatcaaaatgagttctattggaactgggtacgatttatcagcttcccaattctctcctgatggaagagtatttcaagttgaatatgcaatgaaagcagttgaaaatagtggcaccgtaataggcctccgaggtacagatggcattgtattg

SEQ ID NO: 626 - DNA, 160 bp, Diabrotica virgifera
  misc_feature (1)..(160): RNAi target sequence DV-PAT3-FRAG12
gctgctgaaaagctcattatgtcaaaattgcatgaaccaagtacaaataaacgaattttcaacattgataaacacataggaatggcattttcaggcttaatagctgatgcaaggcaaatcgttgagattgctagaaaagaagcatcaaattatagacatc

SEQ ID NO: 627 - DNA, 161 bp, Diabrotica virgifera
  misc_feature (1)..(161): RNAi target sequence DV-PAT3-FRAG13
aatatggttcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccatctgga

SEQ ID NO: 628 - DNA, 80 bp, Diabrotica virgifera
  misc_feature (1)..(80): RNAi target sequence DV-PAT3-FRAG14
ggggagtcgtcaacatcaatttcaagtttcaagaaaaagcaaatcactacgacttgccggattttgtagtagtgttaatt

SEQ ID NO: 629 - DNA, 81 bp, Diabrotica virgifera
  misc_feature (1)..(81): RNAi target sequence DV-PAT3-FRAG15
ttgtattaaaaaatcaaaatgagttctattggaactgggtacgatttatcagcttcccaattctctcctgatggaagagta

SEQ ID NO: 630 - DNA, 80 bp, Diabrotica virgifera
  misc_feature (1)..(80): RNAi target sequence DV-PAT3-FRAG16
tttcaagttgaatatgcaatgaaagcagttgaaaatagtggcaccgtaataggcctccgaggtacagatggcattgtatt

SEQ ID NO: 631 - DNA, 81 bp, Diabrotica virgifera
  misc_feature (1)..(81): RNAi target sequence DV-PAT3-FRAG17
ggctgctgaaaagctcattatgtcaaaattgcatgaaccaagtacaaataaacgaattttcaacattgataaacacatagg

SEQ ID NO: 632 - DNA, 80 bp, Diabrotica virgifera
  misc_feature (1)..(80): RNAi target sequence DV-PAT3-FRAG18
aatggcattttcaggcttaatagctgatgcaaggcaaatcgttgagattgctagaaaagaagcatcaaattatagacatc

SEQ ID NO: 633 - DNA, 81 bp, Diabrotica virgifera
  misc_feature (1)..(81): RNAi target sequence DV-PAT3-FRAG19
aatatggttcaaatattcctcttaaatacctaaatgatagagtaagcatgtacatgcatgcatacactttatacagtgctg

SEQ ID NO: 634 - DNA, 80 bp, Diabrotica virgifera
  misc_feature (1)..(80): RNAi target sequence DV-PAT3-FRAG20
ttagaccatttggttgcagtgtcatcttggccagttatgaagatagtgacccatctatgtatctgattgatccatctgga

SEQ ID NO: 635 - DNA, 81 bp, Diabrotica virgifera
  misc_feature (1)..(81): RNAi target sequence DV-PAT3-FRAG21
gttagctatggatactttggatgtgctacaggtaaagcaaaacagtctgcaaagactgaaatagaaaaattgaagatgggg

SEQ ID NO: 636 - DNA, 644 bp, Diabrotica virgifera
  misc_feature (1)..(644): RNAi target sequence DV-PAT3-FIS (TR)
ggggagtcgtcaacatcaatttcaagtttcaagaaaaagcaaatcactacgacttgccggattttgtagtagtgttaattttgtattaaaaaatcaaaatgagttctattggaactgggtacgatttatcagcttcccaattctctcctgatggaagagtatttcaagttgaatatgcaatgaaagcagttgaaaatagtggcaccgtaataggcctccgaggtacagatggcattgtattggctgctgaaaagctcattatgtcaaaattgcatgaaccaagtacaaataaacgaattttcaacattgataaacacataggaatggcattttcaggcttaatagctgatgcaaggcaaatcgttgagattgctagaaaagaagcatcaaattatagacatcaatatggttcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccatctggagttagctatggatactttggatgtgctacaggtaaagcaaaacagtctgcaaagactgaaatagaaaaattgaagatgggg

SEQ ID NO: 637 - DNA, 367 bp, Diabrotica virgifera
  misc_feature (1)..(367): RNAi target sequence DV-PAT3-FRAG22
aatctaacatgcaaagaacttgttaaagaagcagccaaaatcatttatttggtccatgatgagctgaaggataagaattttgaactggaactttcatgggtatgcaaagatacgaatggtttacataccaaagtgcctgaatcagtgtttgctgatgcagaaaaagctgccaaacaaatggaagcagattcagaatcagatacagaagatatgtaataactacatttagtttttaatatttcgctgatggtggctgttcttacaatatttcgtgtgttatgttcatatattatgtaatactgtgagaatttccatttcaaggataggtttataacttttttttctaataaatacataactttatgtc

SEQ ID NO: 638 - DNA, 182 bp, Diabrotica virgifera
  misc_feature (1)..(182): RNAi target sequence DV-PAT3-FRAG23
aatctaacatgcaaagaacttgttaaagaagcagccaaaatcatttatttggtccatgatgagctgaaggataagaattttgaactggaactttcatgggtatgcaaagatacgaatggtttacataccaaagtgcctgaatcagtgtttgctgatgcagaaaaagctgccaaacaaatgga

SEQ ID NO: 639 - DNA, 185 bp, Diabrotica virgifera
  misc_feature (1)..(185): RNAi target sequence DV-PAT3-FRAG24
agcagattcagaatcagatacagaagatatgtaataactacatttagtttttaatatttcgctgatggtggctgttcttacaatatttcgtgtgttatgttcatatattatgtaatactgtgagaatttccatttcaaggataggtttataacttttttttctaataaatacataactttatgtc

SEQ ID NO: 640 - DNA, 256 bp, Diabrotica virgifera
  misc_feature (1)..(256): RNAi target sequence DV-PAT5-FRAG1
atcaagaacatttgttcagtttgacgcaaaggcgataggatcaggatccgagggtgcacagcaaagtttacaggaggcatatcatcgcagtatgaccctggaagaagctaccacaactgctttaacaattctaaaacaagttatggaagaaaagttgaattcttcaaatgttgaggttatgactatgactccaaaagatatgttccacatgttcacaaaggaacaagtggaagaggtaattgctaaattgtcttaa

SEQ ID NO: 641 - DNA, 200 bp, Diabrotica virgifera
  misc_feature (1)..(200): RNAi target sequence DV-PAT6-FRAG1
aatcatgtctagaggaagcagtgcaggttttgaccgacacataacaattttctcgcccgaaggccgactctatcaagtagagtatgcttttaaagccattaaccaagccggccccacttcggtagcagtccgaggagtagatgctgcggcgtgtgtgacccagagaaagatcccggataagctgattgatcccaacacaa

SEQ ID NO: 642 - DNA, 216 bp, Diabrotica virgifera
  misc_feature (1)..(216): RNAi target sequence DV-PAT6-FRAG2
cagaacacactggatgtgtgatgactggcatgattgctgacagcaagtcccaggtgcagagagctagatatgaggctgccgagttcaaatataagtttggatatgagatgccaatcgatgccttgtgtaggagagtatcggatatttcccaggtttatacgcagaatgctgagatgagacctttgggttgctccatgcttctgataggatatgacc

SEQ ID NO: 643 - DNA, 200 bp, Diabrotica virgifera
  misc_feature (1)..(200): RNAi target sequence DV-PAT6-FRAG3
cacatctgttccagttaacagaacacactggatgtgtgatgactggcatgattgctgacagcaagtcccaggtgcagagagctagatatgaggctgccgagttcaaatataagtttggatatgagatgccaatcgatgccttgtgtaggagagtatcggatatttcccaggtttatacgcagaatgctgagatgagacct

SEQ ID NO: 644 - DNA, 195 bp, Diabrotica virgifera
  misc_feature (1)..(195): RNAi target sequence DV-PAT6-FRAG4
aggagagtatcggatatttcccaggtttatacgcagaatgctgagatgagacctttgggttgctccatgcttctgataggatatgaccaagaaatgggaccatgtgtccacaaagctgaccctgctggctattactgtggctacagagcagtaagtgtaggatccaaacaaactgaagccaacagctacctagag

SEQ ID NO: 645 - DNA, 199 bp, Diabrotica virgifera
  misc_feature (1)..(199): RNAi target sequence DV-PAT6-FRAG5
aagaagctaaagaagaaaactgatctgtccaaagatgaagtcatccaattggcaatcagttgtctttcaagtgttttatctgtagattttaaaccaacagaagtcgaagttggggttgttactaaggatgagcccaagtttaggaaattgacggaacaagaaatagatttccatctgacagctattgctgagagggatt

SEQ ID NO: 646 - DNA, 165 bp, Diabrotica virgifera
  misc_feature (1)..(165): RNAi target sequence DV-PAT6-FRAG6
aggagagtatcggatatttcccaggtttatacgcagaatgctgagatgagacctttgggttgctccatgcttctgataggatatgaccaagaaatgggaccatgtgtccacaaagctgaccctgctggctattactgtggctacagagcagtaagtgtaggatcc

SEQ ID NO: 647 - DNA, 157 bp, Diabrotica virgifera
  misc_feature (1)..(157): RNAi target sequence DV-PAT6-FRAG7
gagaagaagctaaagaagaaaactgatctgtccaaagatgaagtcatccaattggcaatcagttgtctttcaagtgttttatctgtagattttaaaccaacagaagtcgaagttggggttgttactaaggatgagcccaagtttaggaaattgacgg

SEQ ID NO: 648 - DNA, 196 bp, Diabrotica virgifera
  misc_feature (1)..(196): RNAi target sequence DV-BETA2-FRAG1
gcactcagaagcagaagtgcataccatgtaaaccttcttctagctggatatgatgacaaagaaggtcctcagctatattacatggactacctagcatccatagcaagcgttgattatgctgctcatggttatggaggattcttttcactgtcaattatggatcgtaattatcggcagaaccttagtaaagaagaag

SEQ ID NO: 649 - DNA, 187 bp, Diabrotica virgifera
  misc_feature (1)..(187): RNAi target sequence DV-BETA2-FRAG2
tttcactgtcaattatggatcgtaattatcggcagaaccttagtaaagaagaaggttacgaacttttgaaaaaatgtgtgaaagaagttcagaaaagattgatcatcaatttgcctaactttaaggtgcagtgtgttgataaaaatggcatccaggatatgcctaatatcactgctaaggatttggt

SEQ ID NO: 650 - DNA, 155 bp, Diabrotica virgifera
  misc_feature (1)..(155): RNAi target sequence DV-BETA2-FRAG3
cagatgcactcagaagcagaagtgcataccatgtaaaccttcttctagctggatatgatgacaaagaaggtcctcagctatattacatggactacctagcatccatagcaagcgttgattatgctgctcatggttatggaggattcttttcactg

SEQ ID NO: 651 - DNA, 174 bp, Diabrotica virgifera
  misc_feature (1)..(174): RNAi target sequence DV-BETA3-FRAG1
tgtgaagcactttgggagcctaacctaggacctgaggatctttttgaaaccatctctcaagctctcatcaatgcctttgacagagatgccatttctggttggggagctacagtgtacatcatagaaaaaaataaggtgactgtaaaaaatttgaagacacgtatggactagtta

SEQ ID NO: 652 - DNA, 203 bp, Diabrotica virgifera
  misc_feature (1)..(203): RNAi target sequence DV-PROTB-FRAG1
taccagagaacaaaacaaacttttcccactatcaggcactactgttttgggttgtgcaggatgttggtgtgacactctaacattaaccagaatccttaaatctcgcatgcagatgtaccaacaagagcataacaaaacaatgtctacaactgcatgtgcccagatgttgtcaaccatgctctactacaagagattctttcctt

SEQ ID NO: 653 - DNA, 291 bp, Diabrotica virgifera
  misc_feature (1)..(291): RNAi target sequence DV-PBT6.2-FRAG1
tatagtgtaaaactgatttttttattttaatatataccaaaacataccaaagcttaaaaaataatcaattaaccttcataaaatttgggcaattcatttcctaaaacaactcttcgttcaataccagcttcagtgatgatccccagtctgactacacctcctgaagaaccatctcttgacatggcaagtgccaatgtatttgtgacaaacttcacacattcttccttgctcatattgggcttgaagttggcatctacgtaaccataaacataactggaacctgatcctccg

SEQ ID NO: 654 - DNA, 277 bp, Diabrotica virgifera
  misc_feature (1)..(277): RNAi target sequence DV-PBT6.2-FRAG2
attgacacttcttgtctaacacacatcccaccaattggtatggaatatacttgtccgcctttctttttatcccaacctgctaccagtataccagccattagcgaatctctataattgtagcaaagttcttggaaaatggcggcacctacttgtactttgggttcttcaccaagttccataccatgaaaattaagatgataagcaacaatgtctgcaattgcttgtgtatctgctgcagatcctgaacgacaacagtatatatggtcagtgactttgg

SEQ ID NO: 655 - DNA, 257 bp, Diabrotica virgifera
  misc_feature (1)..(257): RNAi target sequence DV-PBT6.2-FRAG3
tgagtttgtctgctacccggtttgcaatgtaggccccagtagttgtgcgagaatctgctcctataacaacgcctccatcaaactccgcggccataatagaggttcctgtactgtgagcggcatctctccaatcattaggaccagtcattgcaccatactcagtcataagaggcattttttacaagtttaatgaaaagaatacaagcttagaaaaattacacttgtaatcctgcaatgcaatattttgccagtccccc

SEQ ID NO: 656 - DNA, 273 bp, Diabrotica virgifera
  misc_feature (1)..(273): RNAi target sequence DV-PBT6.2-FRAG4
caggaacctctattatggccgcggagtttgatggaggcgttgttataggagcagattctcgcacaactactggggcctacattgcaaaccgggtagcagacaaactcaccaaagtcactgaccatatatactgttgtcgttcaggatctgcagcagatacacaagcaattgcagacattgttgcttatcatcttaattttcatggtatggaacttggtgaagaacccaaagtacaagtaggtgccgccattttccaagaactttgctacaatt

SEQ ID NO: 657 - DNA, 219 bp, Diabrotica virgifera
  misc_feature (1)..(219): RNAi target sequence DV-PBT6.2-FRAG5
ggctggtatactggtagcaggttgggataaaaagaaaggcggacaagtatattccataccaattggtgggatgtgtgttagacaagaagtgtcaatcggaggatcaggttccagttatgtttatggttacgtagatgccaacttcaagcccaatatgagcaaggaagaatgtgtgaagtttgtcacaaatacattggcacttgccatgtcaagagatgg

SEQ ID NO: 658 - DNA, 151 bp, Diabrotica virgifera
  misc_feature (1)..(151): RNAi target sequence DV-PBT6.2-FRAG6
ttagacaagaagtgtcaatcggaggatcaggttccagttatgtttatggttacgtagatgccaacttcaagcccaatatgagcaaggaagaatgtgtgaagtttgtcacaaatacattggcacttgccatgtcaagagatggttcttcagg

SEQ ID NO: 659 - DNA, 229 bp, Diabrotica virgifera
  misc_feature (1)..(229): RNAi target sequence DV-BETA7-FRAG1
ggctacagttttgtgtccagaaataccaacgcctggtttttcattcgaaaattgtaaaagaaatgcacttctggaaaataagggccttgctcttccaaaagccactaaaacaggtactacgatcgtaggaatagtctacaaagatggaattattcttggagcagatactagagctacagaagacaccacagttgcagacaagaactgtgaaaagattcacttccttgca

SEQ ID NO: 660 - DNA, 285 bp, Diabrotica virgifera
  misc_feature (1)..(285): RNAi target sequence DV-BETA7-FRAG2
gctaaattagaactccacagattatacacaaaccgagttactagagtgtgtacagcaaaccaattgttaaaacaatatctatttcgctaccagggatatattggggctgctttaatcctgggtggtgttgatattgaaggaccacatctatatatgatttatccacatggatccagtgttgatcttccttatgctacaatgggttctggttccttagcagccatatctgtctttgaatcccgctggaagcctcaaatggaagaggaagatggtgtccaactagta

SEQ ID NO: 661 - DNA, 188 bp, Diabrotica virgifera
  misc_feature (1)..(188): RNAi target sequence DV-BETA7-FRAG3
agacatctgtgtaataagaaagggttcagtagactacaaacgaacctatgacgaggctaacaaaaagggagttaaacaaggatcttatagatatcaaagaggaaccactgcagtgcttagtacccaggtggtggatgttgaggaagtctcagtgattcccattgaagctgaagaaatggatgttgctt

SEQ ID NO: 662 - DNA, 150 bp, Diabrotica virgifera
  misc_feature (1)..(150): RNAi target sequence DV-BETA7-FRAG4
aaggaccacatctatatatgatttatccacatggatccagtgttgatcttccttatgctacaatgggttctggttccttagcagccatatctgtctttgaatcccgctggaagcctcaaatggaagaggaagatggtgtccaactagtaa

SEQ ID NO: 663 - DNA, 168 bp, Diabrotica virgifera
  misc_feature (1)..(168): RNAi target sequence DV-BETA7-FRAG5
cattcgaaaattgtaaaagaaatgcacttctggaaaataagggccttgctcttccaaaagccactaaaacaggtactacgatcgtaggaatagtctacaaagatggaattattcttggagcagatactagagctacagaagacaccacagttgcagacaagaactgtg

SEQ ID NO: 664 - DNA, 156 bp, Diabrotica virgifera
  misc_feature (1)..(156): RNAi target sequence DV-BETA7-FRAG6
gctaaattagaactccacagattatacacaaaccgagttactagagtgtgtacagcaaaccaattgttaaaacaatatctatttcgctaccagggatatattggggctgctttaatcctgggtggtgttgatattgaaggaccacatctatatatg

SEQ ID NO: 665 - DNA, 220 bp, Diabrotica virgifera
  misc_feature (1)..(220): RNAi target sequence DV-NATP1-FRAG1
tgaatatcacatctgcagcgggaattatttccctcttggatgaaccaagaccagaattaaaagtatttgcactgaagaaactagattccatagtgggtgagttttggccggagatctcagaagctatcgaaaaaatcgaaattttgcatgaagacaaagttttccagcaacaccagttagctgcacttgtggcaagtaaggtatattaccatttaggcgc

SEQ ID NO: 666 - DNA, 222 bp, Diabrotica virgifera
  misc_feature (1)..(222): RNAi target sequence DV-NATP1-FRAG2
ttttgaagactctttaacttatgctcttggtgcgggtgatctctttgatgtcaatgcccggagtgagtatgtagaaactattctagctaaatgtatcgactattacactcagcaacgtattgctgtagctgaaggattggcagatgccaaacccatagactctcgccttgaagctattgttaatcgaatgtttcagaggtgtcttgatgatggtcaatatcg

SEQ ID NO: 667 - DNA, 204 bp, Diabrotica virgifera
  misc_feature (1)..(204): RNAi target sequence DV-NATP1-FRAG3
tcaagctatgggcctggctctagaaaccagacgaatggatatctttgagtcatctattactcagtctgatgatattatcagcatgttgacttatgcatttcaagtagcgatgagtttgattcaaaatcgagcatttagaaacactgttttgagatctcttgttggactttatagaggactggttacacctgattacgttaatat

SEQ ID NO: 668 - DNA, 155 bp, Diabrotica virgifera
  misc_feature (1)..(155): RNAi target sequence DV-NATP1-FRAG4
tgtatcgactattacactcagcaacgtattgctgtagctgaaggattggcagatgccaaacccatagactctcgccttgaagctattgttaatcgaatgtttcagaggtgtcttgatgatggtcaatatcgtcaagctatgggcctggctctaga

SEQ ID NO: 669 - DNA, 226 bp, Diabrotica virgifera
  misc_feature (1)..(226): RNAi target sequence DV-NATP1-FRAG5
attaacactaatgcaaagttacttgccgaaagaagttggacccagctcaggttattccgaagggggcggcctttatgctcttggtcttatacatgccaaccatggtacaaatatcattgattaccttcttggacaacttaaggatgcacagaatgagatggtgagacatggaggttgtcttggtctaggtttggctgctatgggcactcatagacaggatgtttat

SEQ ID NO: 670 - DNA, 205 bp, Diabrotica virgifera
  misc_feature (1)..(205): RNAi target sequence DV-NATP1-FRAG6
gaacaactcaaattcaatttataccaagatgatgccaatactggtgaagcagctggtattgcaatgggaatggtaatgttgggttcaagtaattctaccacaattatggatatggttgcatacgcacaagagagtcaacatgagaaaattcttagaggcttagctgttggtattagtttttccatgtatggtagattagaagaag

SEQ ID NO: 671 - DNA, 236 bp, Diabrotica virgifera
  misc_feature (1)..(236): RNAi target sequence DV-NATP1-FRAG7
cagatccactgattcaacaacttacctctgataaagatcctatcctcagaagatcaggaatgtatactttgggtatggcatattgtggtactggacacaaccaagcaattagaaaactacttcatgtagctgtgtcagatgtcaacgatgatgttagaagagctgcagttacagctttaggttttctgttattcagaactcctgaacaatgtcctagtgtagtatcccttctagct

SEQ ID NO: 672 - DNA, 200 bp, Diabrotica virgifera
  misc_feature (1)..(200): RNAi target sequence DV-NATP1-FRAG8
gtatggtagattagaagaagcagatccactgattcaacaacttacctctgataaagatcctatcctcagaagatcaggaatgtatactttgggtatggcatattgtggtactggacacaaccaagcaattagaaaactacttcatgtagctgtgtcagatgtcaacgatgatgttagaagagctgcagttacagctttag

SEQ ID NO: 673 - DNA, 199 bp, Diabrotica virgifera
  misc_feature (1)..(199): RNAi target sequence DV-NATP2-FRAG1
tgggcgatacaaaggtagaacctacaaaggtggataaaacaaaggggactgaggacaaaaacaaaaatgaactgtcggaagaagacaaacagcttcaagatgaattaaatttgtgtgttgagaaactccaggataacgatgaaaagagatacctacttgctttgcaagctttatcaaatcatattcaagcctcaactac

SEQ ID NO: 674 - DNA, 198 bp, Diabrotica virgifera
  misc_feature (1)..(198): RNAi target sequence DV-NATP2-FRAG2
gcctcaactacttcgatgacttctgttcctaagccgttaaaatttatgaggccccattacgaaaccatgaagacagtacatgaaaaaattactgatcctgatactaaaaaagtctgtgcagatattatatctgttttagctatgacaatgggagaaggcagagaatgtttgaaataccgtcttctttctaatttggat

SEQ ID NO: 675 - DNA, 190 bp, Diabrotica virgifera
  misc_feature (1)..(190): RNAi target sequence DV-NATP2-FRAG3
acatctaccatagagtgtgcttatatctcaccagctgtgtaccctatgtggcagatcctgagaatactactctactgcagactgctcttttactgtttagaaagtttgatcagtatccccaggcactgagattagcaatgcagttaaatgactttggattaattgaagaaatttttgtcaactgcccaga

SEQ ID NO: 676 - DNA, 223 bp, Diabrotica virgifera
  misc_feature (1)..(223): RNAi target sequence DV-NATP2-FRAG4
cggacgtacaaaaacaactggcatttatgctaggacgacaacagatatatgttgaaattcctgagcatacgcctgaatacgaagatctaatcgagataatggcaaactgtcatcttaataaccacttcttgaacctcgctcgcgagttggacattatggatcctaaaacccccgaagacgtttacaaatcccatttagaaaatagtcgtcctccatttggtgg

SEQ ID NO: 677 - DNA, 165 bp, Diabrotica virgifera
  misc_feature (1)..(165): RNAi target sequence DV-NATP2-FRAG5
tgctaggacgacaacagatatatgttgaaattcctgagcatacgcctgaatacgaagatctaatcgagataatggcaaactgtcatcttaataaccacttcttgaacctcgctcgcgagttggacattatggatcctaaaacccccgaagacgtttacaaatccc

SEQ ID NO: 678 - DNA, 156 bp, Diabrotica virgifera
  misc_feature (1)..(156): RNAi target sequence DV-NATP2-FRAG6
catctaccatagagtgtgcttatatctcaccagctgtgtaccctatgtggcagatcctgagaatactactctactgcagactgctcttttactgtttagaaagtttgatcagtatccccaggcactgagattagcaatgcagttaaatgactttgg

SEQ ID NO: 679 - DNA, 222 bp, Diabrotica virgifera
  misc_feature (1)..(222): RNAi target sequence DV-NATP3-FRAG1
cttgtgcaggccatgagaaaagcaccccagaatgctgccattggtttcagacaggttgttcaaaagcttactgttgtagttgaactactgctaggagatataccagaacgacagatttttagacaatctagtatgaggcactcccttgccccatactttcaactaacacaagcagttagaatgggcaatttgcaaagatttggtgaggtgttagagaacttc

SEQ ID NO: 680 - DNA, 222 bp, Diabrotica virgifera
  misc_feature (1)..(222): RNAi target sequence DV-NATP3-FRAG2
ggcccacaatttagacaagatcatacatttacactaattttgagactgcgccacaatgttattaaaacagctataagatccataggattatcatactccagaatatctccccaagacatagctaagaaactggggctggattcagctgaagatgcagaatttatagtagcaaaagcaatcagagatggggtgatagaagctacacttgatccacagggaggt

SEQ ID NO: 681 - DNA, 159 bp, Diabrotica virgifera
  misc_feature (1)..(159): RNAi target sequence DV-NATP3-FRAG3
caatctagtatgaggcactcccttgccccatactttcaactaacacaagcagttagaatgggcaatttgcaaagatttggtgaggtgttagagaacttcggcccacaatttagacaagatcatacatttacactaattttgagactgcgccacaatgtt

SEQ ID NO: 682 - DNA, 161 bp, Diabrotica virgifera
  misc_feature (1)..(161): RNAi target sequence DV-NATP7-FRAG1
ctttagttagatctattgtcgctctacacaatcttattaacaacaaactaacaaatagagacgcggaagaaggaaaaaaggaggatagtaagaaagaaagcaaagataaggacaaggataaagagaaggaaaaggataaagatgctaagaaggacgagaag

SEQ ID NO: 683 - DNA, 151 bp, Diabrotica virgifera
  misc_feature (1)..(151): RNAi target sequence DV-NATP8-FRAG1
ttgccaaaaaggctttccagctcaaaccgtggaagctcaacaatgactttttccactttcttcctgaagagaagacccacgaacccataccctcacaggaactggcacagcaggctatagagtatgccaaggaacttgaaatgattgtcta

SEQ ID NO: 684 - DNA, 163 bp, Diabrotica virgifera
  misc_feature (1)..(163): RNAi target sequence DV-NATP8-FRAG2
gctggacaccataagagaagaaattgcagactgtttatcagtagcctatgaaaagatctcagtaaaagacgtagccagaatgctgtacctgccaaacgaagaagctgctaaaacatttgccaaaaaggctttccagctcaaaccgtggaagctcaacaatgac

SEQ ID NO: 685 - DNA, 172 bp, Diabrotica virgifera
  misc_feature (1)..(172): RNAi target sequence DV-NATP8-FRAG3
tgtacaagcagttaaaatcagaatggaataccaacaacccaaatttaagtaaatgtgaaaaactactctcaactcttaagcttgagctcaccaatctaatgtttctgccgattaccacatctactgcgtccaaacaagaactacttctagccagagatgttctagagatagg

SEQ ID NO: 686 - DNA, 673 bp, Diabrotica virgifera
  misc_feature (1)..(673): RNAi target sequence DV-NATP14
actcacggttgtttttgtaaaacttgtaggtaacgaattttcgtttttagtgaattaacaaaacaacagagtgattttccaacaagaataacttatttattagtttcattaatttgataaacaataaaatggatagacttcttcgactaggaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgctgatccagtgtttcaaacaaaaatgcttgacgtgttaagacagactggtaggccagaaatggttgtggggtggtatcattcccatccaggtttcggatgttggttgtctggagtggatatcaacacccagcaaagttttgaggctctcacggaaagagctgtagcagtagtagttgatccaatccagtcagtgaaaggcaaagtcgttattgatgcctttaggttaataaatccgaatatgatggtattgggccaagaacctcgccaaactacatccaactt

SEQ ID NO: 687 - DNA, 246 bp, Diabrotica virgifera
  misc_feature (1)..(246): RNAi target sequence DV-NATP14-FRAG1
aactttagcagattactctgaaaattgtagtgtgaatgaaaagactgtagctgatatgttagaactagccaagaattacaacaaggcattagaagaggaggagaaaatgactccagaacagctcgctattaaaaatgttggcaaacaagatcctaagaggcatttagaagaaaaggttgatattttgatgaccaataatatcgtccagtgcttgggagctatgctagatacagttgtttttaagta

SEQ ID NO: 688 - DNA, 205 bp, Diabrotica virgifera
  misc_feature (1)..(205): RNAi target sequence DV-ATP5-FRAG1
tgacggtaattaacaagatggaggtggacggaggtccgaagggagaaggttttcggtcatattatattacaaagattgaagaattgcagcttatagtggcygaaaagagtcaaaatcttagacgtttgcaagctcagagaaatgaactcaatgccaaagttcgtatgttgagagaagaactgatgttacttcaagagcaaggaag

SEQ ID NO: 689 - DNA, 219 bp, Diabrotica virgifera
  misc_feature (1)..(219): RNAi target sequence DV-ATP5-FRAG2
ctatgtcggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaatacttccaaacaaggttgatcctttagtttccttgatgatggtggagaaagtccc

SEQ ID NO: 690 - DNA, 244 bp, Diabrotica virgifera
  misc_feature (1)..(244): RNAi target sequence DV-ATP5-FRAG3
tagattggacatcttaaagattcactccagaaaaatgaacctcacaagaggaataaatctgagaaaaatagctgagttgatgccaggtgctagtggagctgaagttaagggtgtgtgtacggaagctggtatgtatgcactaagagaacgaagggtgcatgttactcaagaagattttgaaatggccgtcgccaaagttatgcagaaggattctgagaagaatatgtccatcaagaagttgtgg

SEQ ID NO: 691 - DNA, 163 bp, Diabrotica virgifera
  misc_feature (1)..(163): RNAi target sequence DV-ATP5-FRAG4
gattgaagaattgcagcttatagtggcygaaaagagtcaaaatcttagacgtttgcaagctcagagaaatgaactcaatgccaaagttcgtatgttgagagaagaactgatgttacttcaagagcaaggaagctatgtcggagaagttgtaaagcccatggat

SEQ ID NO: 692 - DNA, 176 bp, Diabrotica virgifera
  misc_feature (1)..(176): RNAi target sequence DV-ATP5-FRAG5
tagctgagttgatgccaggtgctagtggagctgaagttaagggtgtgtgtacggaagctggtatgtatgcactaagagaacgaagggtgcatgttactcaagaagattttgaaatggccgtcgccaaagttatgcagaaggattctgagaagaatatgtccatcaagaagttgtgg

SEQ ID NO: 693 - DNA, 1432 bp, Diabrotica virgifera
  misc_feature (1)..(1432): RNAi target sequence ta00611.03_diavv
cagaatcttatctgtaaagataaactaattatctctattgactcacctcattttatacgtagcaggtgaaaatacaccattgtagtgaaaattattattagttcgatttataataagttcgattttttacgaaaatgacaagtatcgagactgtggggaccattgtcctgaaattgctgaagttggtgatcaatttgatatgtctcatcttgtaccgaaccggatatcaaggctacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgttggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaataactttcatcgtaatataaatatatttatttaggttatatactttactttaagcagctcaagtataccgtgacatcccactcatacatcaatgtctataattgtttcatgacaaatcatttaatagtattttaaagcattcattcgttcaacaccttttttacatttttcaagtattatatcaatctttttaaagaattgtttggctattaaccggattcaatccatatagttccgtaaaataattatgcgttttaataattaatgtaattaaaaatagttagtatatttttgaaataaaacaactgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttacatttttcatgaaaattcaattcacattattttcctcccgttctcttcatattatatttatttattctttaatatagttttgggcgtgaagcccagtaaatacctatatgaagtatattgatggaactgccatgcttgatgggttttgtctgcaattaaaataaaaccaaaacaaacatttgtacagtattgtaaaattcacaatatttaggtagatgtttaaaatttaatattttttaagagtttgcatttatgttaatcgtagttaagtttttataaaaatttagtagttgtgagaaataaaataagtaaaagagaat

SEQ ID NO: 694 - DNA, 730 bp, Diabrotica undecimpunctata
  misc_feature (1)..(730): RNAi target sequence ta01434.01_diaun
tttatacgtagcaagtgaaaatacaccatcgtagtgaaaattaatattagttaaaacgaaaagttcgattttttacgaaaatgacaagtatcgagactgtggggacaattgtcctgaaattgctcaaactggtgatcaatttgatatgtctcatcttgtaccgaaccggttatcagggctactttttaggagtaggaggaacctggaatctaaacgaagaaaaaaatcccgatgcagaaatcgtcgcctccggagtattcgtaggattcatgatttatacattcgtctcgctgatcagcctttgcttcgctagtggagatcacaaaacgacattcactgatattctgatgaatatagttgggatttttatgtggatagctgttggagctacagctcttcattattggcttgggtacttgtccgaatacaaatacacaacagtagattctgaacgacaggtcggtttggcgttaggatcgatgtgtatagtaaatggagcggtctatcttgtagacggagtactttccgcaatcttcatcctcaaagccaaaatgcaataaatttcatcgtaatataaatatatttatttagtttctatattttactttaagcagctcaagtgtaccgtgacatccaacacaaatcaatatccataattgtttcatgacaaatcatttaataatattttaaagcattcattcattcaacaccttttttatatttccaagta

SEQ ID NO: 695 - DNA, 1629 bp, Diabrotica barberi
  misc_feature (1)..(1629): RNAi target sequence ta01092.02_diab
tattgactcacctcattttatacgtagcaggtgaaaatacaccattgtagtgaaaattattattagttcgatttataaaaagttcgattttttacgaaaatgacaagtatcgagactgtggggaccattgtcctgaaactactcaaattggtgatcaatttgatatgtctcatcttgtaccgaaccggatatcaaggccacttcttgggagtaggaggaacctggaatctaaacgaagaaaaaaatcccgatgcagaaattgtggcttccggcgtattcgtaggatttatgatttacacattcgtctcgctgatcagcctttgcttcgctagtggagatcacaaaacgacattcactgatattctgatgaatatagtagggatttttatgtggatagctgttggagctacagctcttcattattggcttgggtacttgtccgaatacaaatacacaacaatagattctgaacgacaggttggtttggcgttaggatcgatgtgtataataaatggagctgtctatcttgtagacggagtactttccgcaatctttatcctcaaagccaaaatgcaataactttcatcgtaatataaatatatttatttaggttatatactttactttaagcagctcaagtataccgtgacgtcccatacatgcatcaatgtctataattgtttcatgacaaatcatttaatagtattttaaagcattcattcattcaacacctttttttacatttttcaagtataatatattatacctacctatagttcgttcgctaaactcagacacaactggctagtgatttcggtagataatttttttgattttggacaattttaccaaaattactaactacatatttagtaattattttttgccaattttacgaaattgtcaaaattacttactaaaatcaatagccagttgtgtctgagtttagcgaactgactatatcaatctttttaaagaattgtttggctgttaaccggattcaatccgtatagttccgtaaaataattatgcattttaataattaatgtaattaaaagtagttagtatatttctgaaataaaacaactgccgcaacaaattaggaagaatacttttgtcccctgtatttttatgttatccaaagttcgattcaattgtttcaatttaatgtatttttctatataacgcaccaaatagccttaaaaaaatagtacctactaataccttctactacctaatactttctacgtatgccttatggttagtcgtggctacaataggtgcattttacattttttcctgaaaattcaattcacattcttttcctcccgtgctcttcatattatatttatttattctttaatatatttttgggcgtgaagctctgaagcccagtaaatatatatgaagtatattgatggaactgccctgcttgatgggttttttctgcaattaaaataaaaccaaaacaaaaatttgtacagtattgtaaaattcacaatatttaggtagatgtttaaaatttaatattttttaagagtttgcatttatgttaatcgtagtttaaagtttttataaaaatgtagtagttgtgagaaataaaataaaaccaaaacaaaaatttgtaca

SEQ ID NO: 696 - DNA, 720 bp, Epilachna varivestis
  misc_feature (1)..(720): RNAi target sequence ta26722.002_epiva
gtaaaaactgacttaattaggtttcagtatttttcttgtggttaatttggaaagtgtacgaaaatgaccagtatagagacagttggtgctatagctattcgtgttctgaaactggtaataaatattattgtcattatcctctaccgaacgggcaaccatggggcttttcttggtgtcggtggaacatggaacttaaacgaggaaaaaacggctgacgtggaaattatagcttctggagtattcgttgggtatttgatatacacagcggtctccttgttgagcttattatttggaacaagagacaacaaagtatatttcactgatgtcataatggggcttgttggaatactgatgtggcttacagttggtgcagctgccctacattactggattgggtttatcgacgaacacaaatacacagctgtatcttcggaacgatcggttggtctagcactgggcgccatgtgcatcctaaattcggtcctctatttgatagacacagtggtttcaacgttattcgtagttagagagaaattaaatggctcatttgcttgatgtgtagtaaattcttacaattaggtttacttttatacttttttctatttgttttactgaagattttctctatggagaattcaatcgacccgtgaattgtgttcgcagccatactgttagaatgaagcgaaaaactgaagattttctctatggagattcaactga

SEQ ID NO: 697 - DNA, 1043 bp, Leptinotarsa decemlineata
  misc_feature (1)..(1043): RNAi target sequence ta37400.0001_lepde
acccactgtttccatactagtcattttggcacaatcttatcagtcgagataacgtgattatctgtaccaacttactcacctcattttgttccatagcaggtgctttgtgcctaacagaaatatttgtgacttttcaaagttgattgaagataaacttgtgccaaaatgactagtatggaaacagtgggtacccttttcataaaactgctgaaattggtgatcaatataatcgttttaattttatatcgaacaggattccagggggaatttttgggagtaggtggaacatggaatttgaacgaagagaagaatccggatgcagaaatcgtggcctccggtgtttttgttggttatataatatataacattgtcagtatgatcagcttttgcttcgccactttggatcacaaatacaacttcacagatatcctgatgaatataattggtcttttgctgtgggtagcagtaggagcaactgctatccactattggcacggttatttggccgaacataaatatacccacgtcgactcggagagatcggttggattggccatggggtccctttgcgtcctgaatggtgcagcatatttgatagattcagtgctatcgataatattcttggttaaaacaaaaatgaattgagatcattcactaacctgatatgcatataggataatacttttcttaagttttttatatagaataaaattacgacatgacatgttctgatgatgatacattaaatcctttaagagatagatatcaccagataccaagcacagcatgctgaaatacattctttcattcatatagaattctttaatcatttttgagtagttgggaaaaaccgaatttgtattagtattcattgtaacttatattttagtgtatgtgtccgtttgtaataaaatgaattattgaaaatgtatcgatttcaattcaatcatgagtataattgaacacaataaagaggaacctcagggaagttactgaaataatcgttttatactttaaaataaatattctttaggataaaaaaa

SEQ ID NO: 698 - DNA, 648 bp, Orius insidiosus
  misc_feature (1)..(648): RNAi target sequence ta01487.01_oriin
acgacgctcttccgatctgtgaattaaaaaaaaaagggggacatcaaaaaatcaaagaaaaatggaaatggaaactataattacgatttttattaaagtcataaaatgggtgataaatctcattgtaatcttcttataccgatacggttattctgggcaattcctcggtattggaggaacgtggaatttgaatgaggagaaagatgcgacagcagaagttgtcgcttcgggcgtcctcgtcggctactttatctacacttcggtcattctaatggcattctgttttgggacgacaaaacataaagcgagcgttgtcgacataataatgaacataactgggacgatactttttgtcgcagtcggcggagtggcacttcactactgggccggatatcaaaacatgaatcatttccagccgatagcgactgaaaaacaagtcggtttcgccgtcgggagcctctgcgtcatcgaaggtgccatttatttagtcgacaccgtcctaacttttgttcacatcgttaaaaagaacgacctcttttaatcaaaagtacaaaaaacaatattttactttaaagaaaaattttaatttttataaattttgtattacaactgaagtattataataatattaatcttttttaaaaaaaa

SEQ ID NO: 699 - DNA, 820 bp, Coleomegilla maculata
  misc_feature (1)..(820): RNAi target sequence ta21166.0001_vibdu
aggatcagcttaactatcctaatagctatatctccctgtgttccactctgatcctatattcacttgtttttgtgtgtggtgtttttcatcataatttaattggtaaaaaaaataattttcgttttttttgtggaaaagtgagtgaaaatgacgagtatcgaaaccattggagctatagctattaggatagttaagctgatcctaaatctcatcattttgataatgtatcgaacaggaaatcacggaggttttcttggtgttggtggtacttggaacttgaacgaagaaaaaacagcagatgttgaaatcattgcttcaggagtcttcgttggctacttcatctataccgcagtctcacttatgagtatcctcttcggtaccagagataataaagtatatttcactgacgtcataatgggagtcattggcgtttttatgtggatcacagttggtgcagcagctctgcactattggcacgggtacttggatgaacacaaatacaaatcagtttcatcagaaagaacggtgggattaattatgggctcgttgtgcatcctgaatgcagctttatatctattagactcagtggttgccgttctgttcgtcgtaagagaaaaattaaatggccaattttgaaaaataatttcataattcataagtgtttttttgtattttttcaaatatgaaatcgacaacgagagtttaagtccaaccagaactgatttccagaatgacaaaagccccaaaggctatcctcactgcagttatttcgaaatagtggatacttataatttttaatgaagagcaaatatgaaatcga

SEQ ID NO: 700 - DNA, 5238 bp, Diabrotica undecimpunctata
  misc_feature (1)..(5238): RNAi target sequence ta00809.07_diaun
cgaactttactaaccgtagctactttttttgatgtgatctttatgttgcgctcatcagtagtgcgccagtttgtagtgccaattaaccaaaatgtggttaaagtactttgttatttttgttttgtttagtgttagcattaaaggacaagacgatggacttccaccagatgtagaaactatcgacaccaatgtaagtaacgcggagccagatgtagggaaacctattccggtggaagatacgcctaatggagtgtctccagtgaatccaaactatgaagtagataaatccctagttaatgtaagcaatagtttggtaaatgtgactaaaaatcccagacggacttatcagacagttaacaaactgggcaaatattcgacattttatgctgcagattacgatcctatgacctcagacaccgctccaccagacactgaccaacgaggaggagggactccatacactataaccgaaacgagattggcagaaataaggaaacattttatgtacccatttttcgataaaggaggtagtgataataacttgggagatttccaaaaggacattcaatcttccattcctcaggtgcacaagaatttaaacttccaattgcctttctttggattcaggtataactacacaagagtgtcagtgaatggatatctggaatttagcgacccacctccaaattatgactatcctttagtatttcctattaaagaatggcccaaaaagaatgatcctgcctttattggtatattcttcagcagatgcagaatcggtaatcttcgtgatggagacgtcgatcaaagaacaccaggggtctattttagaatggaaagagatttaagaaccaggcaagacagaatgggtgtagaaattagagaaagacttaaatgggacatcagagaaggcgtcattggatctgacaccttcgatcctaagcacgccgtgattgtcacttggaaaaatgtttccttcactggaggattcgctaatgctaagtacaagacaaacaccttccaaatggttcttgcaactgacgaagtattcacttacgcgatgttcaactacctaaacttggactggacctcccacactgaagccggtggtgattcgcaaaacggagaaggtggtgtcagtgcctacgttggttttaacgcgggaaatggtactagaagctacgaatacaatccttacagtcaagcttccgtcattcgagatcttacttcagttggatttggaaatggttttaagggaagacatattttccgtattgatgaggaaattttgcttggatcgtgcaacaaagatatagatggtgccaaccttcccctgaaattcgctcctgaaagtggtaatatgttgggaggaaccgtggtaaatataacaggtccatgcttcaatttgaatgataggattcgatgcaagtttgacgtttcaaatgaagtattcggttatgttgttgataagaacagagctatatgcgtacagccccaactgtttgccgaaggatgggttaatcttcaaattgctataaattctgaatcattcaagtggaagggaaagtattatgtagaatccccttctagtgcaacccaaaaaatcttcttcaaggacatgaaataccacgaaaaatctccgagtgaattaaaaataacttgggagaagcaaaatttgaccacaaatgaaaacgctaacatccgaatttccctctggggttacagagaaacaactatgaaaccagtgtttgtttatatcaccgatatcgcagatagtgttcaaaacattggagaatacacgattgttccttctcagtatagaactagagtaaaccaatatttgactgatattaagtttggattcctccaaattaatttaactgagtctatcaaagttaatacatacactacaacccaaacaaccatagaattaacaccggtagtatggagccggcccattccactcggttggtattttcaattccaatgggagaaccagtacggcaaaaattggcccaaaactctatgtgacgattggctgagaacggacagatatctaaagaacttcgctcacgaacttgctcagtgtccctgcaccgtcgaacaggctttagctgacaagggcaggtttatgccagatttcgactgtgacaaagattcgaatccgatttgttactataacaaccaagcacttcattgtgtgaaaactggatctcccactttagaaggttctgaacaacaatgttgctatgataaaaacggctttttgatgctctcttacgatcaacaatggggttctagtccgagacgttgccacaacttaggtaaaatgccttacaatgaagcgacaaaagttcctactctctcacaatggtttaatgatatggtacccaaatatttatgttgcctttggcaagacgagcaagctgttggatgtgaaacactgagatttgaacgtagaccaacacaagattgtgtagcttaccaagcaccaggcgtcgcaggagtctatggtgatccacactttgttactttcgacgatgtagaatatacgttcaatggaaaaggggaattcgcattggtgaaatcggttacacaaacggacaatctggaaattcaaggaagattcgagcaaatggaccctaacgcttatggtgaggttagagctactcagctgacatctgtagtagctaaaggtaataacacaatagcaattgaagtcagaaggcgaccactagattctagatggagatataggttggatgttatagcagataatagaagactgtatttcgatagaccctcactaaaattccagcacttccaaggagttactatttatactccaacctacatccttaatcaatcagaagtcatcattatgtttgacaatggagctggaatggaggttgtcgataatcaaggatacatgagtgcaagagtatttttgccttggtcgtttataaataaaaccataggcctttttggaaattggagtttcaacaaagaagacgactttacacttccagatggttccagagcagcaatagtctctaacataaatgacatggaaagggtttacactgattttggttccaaatggatgttagatgatgtgttagatcctcaaaagggtagagcgttattccatagggaatttggaagaacttcagccacttacaacaacaagacgttcaagcctcaattcctaatgaccccggaagatttcataccagccaacagaactgcggatattcagcgaacatacgaaatatgtcctctaaggatgtacgaatgttactacgattacggtatgacgcttgatagggatttggcacattataccaagaattataaagccacaatatatcaatataaagaaactacaaggaccaaagttgtgtcttgtggtgtactggaaacaccgaggtttggacgaaagagtactttcctgttcgtgcctggaactaaggttacctacgaatgcattcaggagttcgtgctggtaggtgatcagcgcagggagtgtcaagcggatggaacgtggaatattcctgaatacggatacacttattgcttacgtcagcaagaatactcccaacgacaggctggtctggcttccgggataattatggcaattcttataccgctcatcttgcttttcgtctatctagcgtatcgtttcttacaaaaaaagcagaaagagaaagaagctgaaaaattagaagagcagcaatttatggatcaacaaagaagggcacacgaagcagctactaagaagttaacagaagccgaatatgcttcagaagatgaagacagtaatgttacaagcacgggcgcaaaagaaacaactgtatattaactcctataaaatacaatgattcaacctatgagttgcaacattttaaagtttaatatttctaaaatctttatatagaataagtactagatgtagttaatgtataaataggacttttttattgtaggattaaaaatccactgatgactaaattcaaacactatgttttattcaataaagtgtagacttttttatgtttatgttccatgtagagtgtgatgtgtcaaatatggcgtttttaaccaccacgtaatgtcttcttcctatagtaaatttaatattcttcaaaggtacttgtccattgaattgtatgcctatctaatcctgtaatgcccatctttttttttcgaattaaatgaataatacaaaatttgaaaatcaaaataaattaatcaacttcatataacccggtagaaagcgatgtcctgcaactattatctaaattaatatattattcagtaaccatatcaagctctattagtggtgttatactcctgtattttataaacaacggtttgttaatccaccaacttgcttctatttgagaagatgaatcaatacgctcagctgctcacataaaatttcacatagaatcgtttcaagcaagccagagtcatactcacaatttgtcaaaatttttgccgacaaactgtatttagcatagaactatcttatactaggaagatcagaaaatatctatgccatgaacttaagcacaaaactagccaaatgaaacggcttattggaagggatatgaagtggaaaatggatgtacctaattatgctaaaagtttttcacataccaaagcatttcacaaatttcggccgaatattgttatcacagtaattgtatcttgcatcgttagtctgaaatatcatacatcgacaaaattattagatctaaaatcatcctaagctaaacatacagttcaaaaccattgttgcgtggttacaattctagttttgtgtataaacttcgtccacataagtcgaatccggtttgaatctactcacgagtttgcgataatcggacttttagatttatatatgtatctaatccaggattccaaatataataatgtctaaaatgtaattgttcaaaccgaagtaggaatctctaagaccacttaattataaaagtagttatttgaaagagaaggtaatagttacctgcgttcacatatacaaattaattagaacttgaaagaaattcgttgttaaaacacctatgaaaagaaaaattgatttagtcaacgaaggattccttctagaatgttctatgttatttattaagtacaacatattttcctaccttagtaatactttactttattagaaaatctagtacagttcgtgttaaatctcaaatttactattat

SEQ ID NO: 701 - DNA, 4313 bp, Diabrotica barberi
  misc_feature (1)..(4313): RNAi target sequence ta06241.06_diab
aaaacataactttttgactgaagaatgtttctaggtacagcggcacaaatactttggtcttaagatagtaaaataatgaaaatttataaattaaatgatactctataaactattgaagttcacttctactctaattatattctaaacgtctgtcactatactactctgactagcgctaatcctttctttaggtttctttattggttctgcatacatgtcgttatagttcaaattctttgagctgttccctctaataatgtctggtcgactataaggcgttgtatattgaatactagaagtaggactagttggacttcccgtaggcgttctagaaaccctatcgtcttcgaaggtttgatcgtaagggtccaatggcttctcctcgaactcagaattcggtctattgggcaaaggttcgtgagttctgtaggacttgtcgtaacttcttcgtttcttgctaagcgagtcagtgtcgctttgaggatacttttcgtcctcgtcttcttctctgtatggacttaaagttcgactgaattgttggagattttgagtcttttgtacggtgtcgtagtcatagttttgattgttacttgttagtctttgatatactttgtagccaccgtaacctattagaagaaccaatggtatgataattgcgaggattatacctgaagtgatggcagcttgacgcgaagaatattcttcttgacgtaagcaatatgtgtatccgtattcaggaatattccatgttccatccgcttgacactctctccgctgatcacctaccaacacgaactcttggatgcattcataggtaaccttcgtaccgggcacgaacaggaaagtactctttcgtccgaatctcggtgtttctagtactccgcaagacacaactttcctccttgtcgtttctttatattgatagatcgtggctttataattcttggtgtaatgcgccaaatccctgtcaaccgtcatagcgtaatcgtagtaacattcgtacaactttagaggacatatttcggatattcgcttaagatctgtagatctgttggttggtaggaaatcttccggattcattaggaattgaggcttgaacgttttgttgttgtaagtcgctgaagttcttccgaattccctgtgaaacagcgctctacccttttgaggatctaacacatcctccaacatccatttggaaccaaaatcattgtaaaccctttccatgtcatttatgttattgactattgctgctctagaaccatctggaagtgtgaagtcatcttctttgttgaaactccaatttccaaaaaggcctatggttttatttataaacgaccaaggcaaaaatactcttgcactcatgaatccttgattgtcgacaacctccattccagctccattgtcaaacataatgatgacttctgattgattaagaatgtaggttggagtgtaaatagtaacaccttggaagtgctggaattttagtgagggtctatcaaaataaagtcttctattatctgctataacatccaacctatatctccatctagaatctagaggtctccttctgacttcaattgctattgtgttattacctttagctactacagaagtcagctgagtagctctaacctcaccataagtgttagggtccatttgctcaaatcttccttggatttccagattgtccgtttgcgtaactgatttcaccaatgcgaattctccttttccattaaacgtatattctacatcgtcgaaagtaacaaagtgtggatcaccgtagactcctgctacacctggtgcttggtaagctacacaatcctgtgtaggtctacgttcaaatctcagtgtttcacatcccacagcttgctcgtcttgccaaagacaacacaaatatttgggtaccatgtcattaaaccattgtgagagagtaggcacttttgtcgcttcgttgtaaggcattttacccaagttgtggcaacgtctgggactagaaccccattgttgatcgtaagagagcatcaaaaagccgtttttatcatagcaacattgttgttcggagccttctaaagtgggagatccagttttcacacaatgaagtgcttggttgttatagtaacaaatcgggttcgaatctttgtcgcaatcgaagtctggcataaacctgcccttgtcagctagagcttgttcgacggtgcagggacattgagcaagttcgtgagcgaagttctttagatatctgtccgttctcagccaatcgtcacataaatatttgggccaatttttaccgtactggttttcccattggaactggaagtaccaaccgagtggaatgggtcggctccatactaccggtgttaattctatgctgctctggcttgtagtatatgtattaactttgatagactcagttaaattaatttggaggaatccaaacttaatatcagtcaaatattggttcactttagttctaaactgagaaggaacaatcgtgtattctccaatgttttgaacattatctgcgatatcggtgatataaacaaacactggtttcatagttgtttctctgtaaccccagagagaaattcgaatattagcgttgtcgtttgtggtcaaattctgcttctcccaagtgatttttaattcgctcggagatttttcgtgtaatttcatgtccttgaagaagattttttgagtcgcactagcaggagattctacataatacttccccttccacttgaatgcttcggaattaacagcaatttgaagattcacccatccttcggcataaagttgaggttgtacacagatcgctctgtttttatcaacaacatacccaaatacttcatttgatacgtcaaacttgcatcgaatcctatcattcaaattgaagcatggaccagttatatttaccactgttccacccaacatgttaccactttcaggagcgaatttcaggggaaggttggcaccatctatatctttgttgcatgatccaagcaaaatgtcttcgtctatacggaaaatatgtcttcccttaaaaccatttccaaatccaactgcagtgagatctcgaatgacggaagcttgactgtaaggattgtattcgtagcttctggtaccgtttccagcgttaaaaccaacataggcactgacaccaccttctccgttttgggaatcaccacccgcttcagtgtgggaggtccagtccaagttgaggtagttgaacatcgcgtaagtgaagacttcgtcagtggcaagaaccatttggaaggtgttggtcttgtatttagcattagcgaatcctccagtgaaagaaacgtttttccaagtgacaataacggcgtgcttaggatcgaatgtttctgatccaatgactcctgttctgatgtcccacttaagtctttctctaatttctacacccattctgtcttgcctcgttcttaaatctctttccattctaaaatagaccccgggtgttctttggtcaatgtctccatcacgcagattaccgattctgcatctgctgaagaaaataccaataaaggcaggatcattctttttgggccattctttaattggaaatactaatggatagtcataatttggaggtggatcgctgaattccagatacccattcactgaaactctcgtgtaattatatctgaatccaaagaaaggcaactggaagtttaaattcttgtgcacctgaggaatggaagattgaatgtccttttggaaatctcccaagttattatcactgcctcctttatcgaaaaatgggtacataaaatgtttccttatttctgccagtcttgtttctgttatagtgtatggagttcctcctcctcgttggtcagtgtctggtggagctgtgtctgaggtcataggatcgtaatctgcagcataaaatgtcgaatatttgcccagtttgttaactgtctgataagtccgtctgggatttttagtcacatttaccaaactattggttacattaactaaggatttatctacttcatagtttggattaactggagcgactccattaggtgtatcttccaccgggataggtttccctgcatctggattcgcgttacttacattggtagtgtccacatcgatagtttcaacatctggtggaagaccaccatctagtcctttaacgctaacactaaacaaaacaaaaataacaaagtactttaaccacattttggttatttggcactacaatctggcgcacatcacatcaaaaaaagttgctacggttagtaaagttcgtactcgagtgtttgcaagaatcgctagaacgagat

SEQ ID NO: 702 - DNA, 1564 bp, Epilachna varivestis
  misc_feature (1)..(1564): RNAi target sequence ta29117.001_epiva
cttcaatggaaaaggtgaattcgtgctgatgaagactaacgtggcttcgcagaggttagaagttcaagctcgtttcgatcaaatgccacctaatgaatacggtcaagttagagccacccagctctcctccatagctgtcagaggcaattcttcgactattattgaagttagaataagaccaaaggaagccaggtggagatataaaatggatgttattgcggataagcaaagaagacttttcttcgaccgaccttcgcttaaattccaacattttccaggtctaaccgtttacactccaacatatatcctgaaccaatctgaagttattataatgttcgactcaggagctggtgtagaaattgtagaaagtttgggattcatgtcagcaagagtttacttaccatggactttcataaataaaacaatgggacttctaggaaattggagttttgacatgaccgatgatttcactttacctgatggtacaaaacgacctgtttctggtaatatcaacgacatgcaagacatttacgaaaacttcggcaagaaatggatgattgatgactcagacgatcctcaaaaaggaaaatcgctgttctttatcgaaaacggacggactgcagccttctacaacgacctaaatttcgtacctgaatacagcatgaatataaactacatactggcaaacaaaacaggtcgtattgaaatggcaaatcaatggtgttccaataaagactatcagtgtatgtacgactatgcgatgacattagataaagatatggctttttataccacaatttttaaatcgggcttgcaaaacctaagagaagcggcaagcaaaagggtaacgtcttgcggtgtgttggaaacgcccaggtttggttggaaaacgaatttcttcttcacgcctggaactaaagtcagtttcgattgtgctcaagacttcgtattgagcggtgatcctagaagggaatgcctgaagaatggagagtggaatatcccagaatttggttatactgaatgtttacgtgaagaagaatattctctgagacaggcaggaactacatttggaataatacttgcagtgatgattcctcttatacttttatttgtattctttggttacaaatatcttcagaagctgacagcgcaaaataatgagcaatatgaagagaaaatgacattggaacaacaaaaaaggttagcacaagaaagggcagctaaaaaattaaccgccgttgatgaggaccatgatgatgatgtgctttcggaaacaaatacttcatcgccaagagaaacaacagtgtattaattcgtaaatttcgattagtcatgagttaggaaaacgtagtttgccatcattcataatattttacttcaaaatttgaatgtgaaaattttttcaaaaaatttttaaatatggatatataaaattataggagtttttgtttgatgattgttaagtagaatccaatcgctctctataaatcaaaaaattcagagacagaacagctcttttagatttagaggtattttaaatgttcataatcgcattttacatttc

SEQ ID NO: 703 - DNA, 5020 bp, Leptinotarsa decemlineata
  misc_feature (1)..(5020): RNAi target sequence ta36833.0009_lepde
ataacaaattttatcttgttacagagcacacttgtgagaaggcaatcgagtaacgaacctcatacataaaagtacacgtatggtgatagaaaacaataaattatcaaactgaggctctgtgccaagttttggaaaatgtacgtcaagtggaaattggttttgactctagtactgtgtgttggtgtcgtgattggggaagatatttcaacagatataatccccttgccacaagacaatacagcagatgtggaaatagtggctacagaaactaggtcaaattcaggatctgaagctgctgtagaagagcccaccaataacactgggccttcagatactacaaacccaaattatgctgtagtgccccctgtagtttctgatagcaaacctgcaataacaaatagtgaaacaaatgacactaacaatgatgttgtaatgttgagtcctacgaaatttctcatgaaaaagggacgatctggacgtttattggaatatccgactgattacgatcctatgacttcccatattgctccaccggatagtgatcagagaggatattcaggagtaccatatgtcttgacggaaaccagactgcaacagatccgccaaaatttcatgtatccctactacaacagaggcggtaatgcagatgacgaaggagactaccagaaagaaattcagtcatctattccgcaagtgtacaagaacctcaacttccaactccctttcttcggatttcgattcaattacacgagggtctccttaaacggctatttggaattcagcgatcctcctccaaattacgactatcctttggtctttccagtcaaggaatggcctaaaaagaacgacccttctttcatcggtatctttttcagtaaatgtagaatcggtaacctgagggacggagatattgatcaaagagaccctggagtgtactttaggatggaaagggatctcagaaataggcaggacaggatgggagtggagatcagagaacgactgaaatgggatataagggaaggggtgatagggtcagaaacattcaatcccaaacatgccattatagtcacatggaaaaatatctctttcaatggaggttttggcaatgctctctaccagactaacactttccaaatgatcctcgccactgatgaagttttcacctacgccatgttcaactacttgaatcttgactggaccacccacactgaagcgggaggcgacacaagaaaaggagaaggaggagttcccgcttttgtgggattcaacgctggaaacggtactagaagttttgaatacaaaccatacagtcaagaatctgttattcgagatctcacacaaactggtttcgctaatggtttcaaaggaaggcacattttccgaatcgacgaaaatatcctaactggaacatgcaataaagatatagatggtgctaatctaccgctaatgatatctccagaaagtggaaatatgctgggtggaacaatagtgaatataacaggaccttgtttcggcctagacgaccaagttaaatgcaaatttgatgtagcaaatgaaataaatggcgtcgttatagataaaaacagggctatatgcatccaacctagactgtatgccgaaggatgggtgaatttacaaatagccataggggctggggtatacaaatggaagggaaaatattatgtcgaatcccccgcagcggcatctcaaaaaatctacttcaaggacatgaaggttcatgaaaaatcgcctagtgaaataagaataacttgggaaaaatacaacttgaccactaacgaaaacgctaacattcgtatctccttatggggttacagagaaacaacaataaggccaacgttcgtttacatcactgatatcgcagacagtctccaaaatactggagagtataccatcgtaccgtcccaatatagaacaaaagttaatgagtttctcacggatatcaaatttggtttcttgcaaattaacttgactgaatctatcaaagtgaacacttatacatctgtacaaagatcggtggaaatagttcctgttgtatggagtcgacccattcccctaggatggtactttcagttccaatgggaaaatatgtatggacgaagctggcccaaagcactctgcgatgactggctaagaacagacagatacctgaaaaactttgctcatgagttacctcaatgcccttgcactgtagaacaggctttggcagacaaagggaggtatatgcccgactttgattgcgacaaggactcaaatcccgtatgctactacaataaccaagctctgcactgtgtgaaaacaggatcaccaacgttggagggatcagaacagcagtgctgctatgacaaaaacgggtatctcatgttatcatacgatcagcagtggggttcaagtccacggcgttgccacaatctgggaaaaatgccctacaacgaagcaacaaaagttccaaccttatcgcaatggttcaacgatatggtaccgaagtatctttgctgtttgtggcaggaagaacaggcggtgggttgcgaaacgctgagattcgaaagaagaccaactcaggactgtgtcgcgtaccaagctccagggattgctgggatttacggagatccccacgtcatcactttcgatgacgtcgagtacaccttcaacgggaaaggagagtttgctcttgtgaaatctgtgacacaaactgacaacttggaggtgcaaggcagatttgagcaaatggaccctaacgcctacggagaagtacgtgcaacacaattgacttcaattgtggcaaggggaaacaacaccatagcagtggaggtcagaaggaggcccttggatgctaggtggaggtataggctggatgtcatagctgataataggaagttgttcttcgacagaccctctttgaaatttcaacatttccaaggagtgactatttatacacctacttatatcctcaatcagtctgaagtcatcattatgtttgataacggagcaggagttcaagtaatggataaccagggattcatgaccgcgagggtgtatcttccttggtcattcatcaacaaaactgttggtctctttggcaactggagtttcaataaggaagatgacttcactcttcctgatgagtcgaaggctgccgtcgtgagtaatatcaatgatatggaaagggtctacaatgactttggttccaaatggatggtggacgacgtactagatccgaaaagaggtagatccttatttttcagagaattcggcagatcatcggcaacgtacaacaacaaaactttcaaaccgcagttccttatgttacctgaggacataatacccgcaaacaggtcgatacagatacagagaacttacgacatttgtagcacaaaaatgtacgaatgcttctacgattatgccatgacgctcaacagagatcttgcccattttactcagaattataaagcaaccatatatcaactcaaagaaacgacgaggcagaaggttgtttcttgcggagttctggaaacaccgcgattcggtaggaagagtacttttctttttataccaggaaccaaagtcacttacgagtgcaatcaagacttcgtattggtgggagatcccagaagagaatgtttggcagatggcacatggaatgctcctgaatatggctacaccgaatgtttacgtcaacaagaatattctcagcgccaatcagccattgcctctggagccgttctcgcaataattattccactagttctattatttgtatatctggcttatatgttcctcaagaagaaacagaaagaacgagacgaagaaaatttacaaacgcaagcgtacgagcaacagaaaagacaagctcaggaagctgctgctagaaaattaactgctgccgaagagtacaactcagatgaagacgataataacagcaacgttacgagcacagcaaaagaaacaacagtgtattagtattagatatggtaacacttttacgatattattattttggttggcatacttctcagacaaacagtccaaattattatttgcaacaagaactatttgaatttcgaagtttcctttgaagatcccaagttgcttattatcctaaatttttgcaaaatgtcaaaatcgtactattccatcagttgtatattttatttttctgagatagttaggccaacaggtatctaaaggagtgaataacagatttttcatattttccagttttatctgattcaataatgcactatgggttttttctgttaatggtttttataacacctctgttgcaaaatacatattaggtaatataaatatacgtaattaagtcgtaattaagtattataacaaaatggcgttctctattatttaaattgtaattagatatatattttttatattcataatcacttttgcatgtaaagtaggagtccaattttctgtacttcaaccatcactatcgctacttaccccgatcactttttggatgcacatttcatgcacatttttgcacattgtttgcacagtaagttcactttgcaaacaatgtgcgaagactatgcgggaggacatgtttatgcagtaattttgtatatatgtgagtaggtatatacctactattttcatcatactctggtcctacttttcttatttacagtgataagatgatgtttgaaatcttgaattaggtacaatgaattcatttttgtcagttatttgaaacattttcggatattttaataagactgtgttttatcaaagttcagtttgattgtccaaatactagtagatcattagagtcctactgtagttttagcattttaataaagtaattcaatattaatatacaagtaatcttgcacttctgctaactcaaaattttgcaaaattattcactcgaatcagtattcacacgtttctctttcagaaataaccaaaatatttcaccccatacacaaatttcattaggtttagtgaaatttgtgtatggggtgaaatattttggtta

SEQ ID NO: 704 - DNA, 3724 bp, Orius insidiosus
  misc_feature (1)..(3724): RNAi target sequence ta02139.06_oriin
tttttaacgttaataaaacagttttttaatataaaaaaagtgtacaaaagtttagtatatgtcggtttctacgctatcggcgcgacgcatttgagatttgggggagtcgaacgagctgtcggttccgtcttcgaagtcgatgtcggggcggttcggaaggggctcgtgtgtattgtaaacggcgtcgaaattgctcggattcctaacgagtttatcctcttctttaccccggccagataaggaagaacgcctcctgctgtacttccagctttggaccccgttctgaagacgggctgagtgacggcgataaaaccacgtcgcgatacagaccagtgtgaggaccaacggcaaaagaatgcccaaaatcataagcgacatattcgccagttgttgcctgtcgtattcgacatacctgagacattcggtgaacccttcatccccttcgatccatttcccttgagcggagcacttcctttgttgatctccaacaaaatgaaaccttgatcgcattcgaaaataactttggtatcaggaacgaagaagaagttacttttccttccaaatcttggcgtttcaagaactccacagctcaatgttctcattttgttggtctgcttgatggatgaatattcgctgaagtagtccaaagtctgtttcgccatttcacgattgaggctcaccgcgtaatcgtatttacattgatacgagtcgccgcagaggtcttcagccttagagacgtcctgtgtccgattcggtggtatgatttcctgaggagtttttttccattctggtacaaaagtacgattcgcatagtacgatgctgaacggccatactcccttatgaagaggggctccccttttttcggatctgctctatcttccagcaaccatttgagagcaaaatctttgtgtattcgttcgaaatcttcaaggtctccgacttggacgatttgtccgtcaggagtggtgaagtcatcggaaatgtcgaagctccaatttcccatcaaacctcgcgtttgattgatcatcatccagggcaagtagacacgacaggccatgtatcctttgttctcaactacctcaactcctactccggtttcgaacataatcacgatctgcgattggtccaaaacctgagatggcaaatagacggtgacgcctcggaagtgctgaacacgaagtgcaggacggtcgaaaaagactcgacgtttgttggcgaaaacgtccaatctgtatcgccattgggcgtatcttggtcgcaagcggacttcgatgatcgccgaattatttcctctagctgcaacagatgtcagtaaagtggcagcagtgtctccgtagatattcggcccgacctgttcgaatctcccttgtacgtcaagtttgtatttatctgttgaagaatggagcaaaacgaattcgcctttaccgttgaaagtgtattcaagctcgtcgaatgtgacaatgtgaggatcgccgaagacggtagcgacgtaaggcgcttggtatcctacgcagtcttgactgggtcgccgttcgaaacgtaatgtctcgcatccgacagcttgctcagactgccataaacaacagtggtagaatgggcttatatcatgccaccactgcgataatgttggaactttgttcggctcagtccacggtaaaagacccaaatttgatgatctcttcggcgaagacccccatttctggtcgtacgacaacatcaaatattcgtttttgtcataacagcattgttgttctgctccttccaaattcggagcaccagttttgacgcaatgacgtgcacctttgtggtaaaaacagttcggattcgcgaccatatcgcaatctggatcgggcaaaaaacgccctttgtcgtttaacgcttgctgtaacgtgcacgggcattgggccaactcgttagcgaaattcttcaaaaatctatcgttcataagccactggtcgcatttcgcttctgcccactttttcccgtagagtctctcccattgcggagcgaagtaccatccgagaggtatcggcttactccatattacgggggttatgctaagtccttgatattgggtcgggtttgtcaagttgatttgaatgaagccgaaagtgagctcggacaattcatagttgttccttgtccggaaattggccggttgtatgacgtagctgcctgtgtttgccacacctgattctaacgtgtcaacgtaaagaagtttcggtgctatattcgtctctttgtacgcccaaatcgaaatctgcaaaggagccgcagaattggaagttaaattgtatttgttccacgttattttgatttctccaggataagcatcattcacacttccataatgatcgttctcagcaaaagagatcctttgcgtcgccgtcgctggagtttcgacaaagtatagtcctttccaaatatatttgtcgtcgtttaacgagatttcgaagggtatgtaaccttcagccatgatgaaaggctgaacgcatatcgcccggttggtgtcgaccactgttcctaaagtcggcgtcgtatcaaacctgcatattatcttcatttctttggtaaaacaaggtccggtgatgttcacaatagtcccgcccaacatgtttccagattcaggtgcgaaattaaggtccaaacttgctgcggctatatccttgttgcaagatcccggaagaatgttttcgtcaatacggaatatgtgacgtccaggaaatccgttagcccaaccacgccccgttaaatctcgaatcgtacttgcctgcgaataaggtttatattgataagtccgagtcccgtttccagcattgaatccaacaaacgcaggagtacctccttcacctccagtggtatcaccatttgcttcagtgtgcgttgtccattgtatgtccgcatagttgaacatcgcatatgtgatgacttcatcagtagccaatacaagttggaatgtattcgttttgtagagactgatgtcgattcctccggcaaaagatacgtttttccaggtgatgatgactgcgtgttttggaacgaatgagtcagaaccgatgacgccctgacggatgtcccacataagacgttctctaacttcaaccccgaaacggtcagtccttccttgtaaatctctttccattctgaagtagacaccaggaggtctttgatccacatctgtatctttgatgagaccgatacggcatttggaatagaaaataccgataaaactcggatcgttctttttgggccactcgaccgtcgggaaatgaagggggtaactgtactgttctggagggtccgaaaactcgagataaccgtttaagcttacgcgtgtgtagttgaagcggaaaccgaaaaagggaagttggaaattgaagtttttatggatttgggtagaggaaggatgaatgtctttttgtaggtcaccggaatcatttggaccacctttatcgaagaaccaataaaggaagttggaacggattttccgtaaacggtcttcagttatcacgtacgggagttccccaggccctgcacgttgcgttggaggtgccgtcctttcatcatcaaaatcgtatggatttctcgggttgtaggggttgtaaggagtcaaaaccctcgaaggctgcctgtagttgttgctcctcacgttgataacttcattgaaccccgggcgcacactttgtcctctttggccttccgaacttttcaaaaagtaaaaaa

SEQ ID NO: 705 - DNA, 3845 bp, Coleomegilla maculata
  misc_feature (1)..(3845): RNAi target sequence ta22533.0010_vibdu
caaatttcaaaatagaaatgaatctaaaagattagcaaatccgatcattagtgatgtacaatactgatgaacggaacattttaacatggtgaaaattcgaatattagttactttttgtatattcaaatttgttctgggtgaaggaagtgtcagttctaatgatgtggaaagcattgttggtgtgcctatgaaaaaagaagtacttggagctataggagaggataatactgatacattccccaatgtaaatggagccggtcctgataataattacgcatccgccccgattcctggagcttctgttactttccataggccttcagggaaatatataaccaactatgataacaattacgatccaatgcgctcgaatgttgcgcccccatccgtagatcagaggggtggttccggcttaccttactacataactgaagataggctgaaagaaatacgttctctgtttatgtatccatactataataagggtggaggtggtgacaacgatggagattatcagaaacaaatccaagcctctacttcaatcgtacacaagaacctgaattttcagcttcccttcttcgggttcaggtacaattacactagagtttcactcaacgggtatttggaattcagcgatccaccaccaacctatggcaaatatccactcatctttcctagtcctggatggccggaggtgaatgatccagctttcatcggaattttttatagcaaatgtcgtatgggtcttctaagggctgaagatatagatcagaggaatcctggagtgtatttcaggcttgagcgggatttgaggagcagaaccgaccagatgggtgtcgaaataagagaaaggaccaaatgggacatcagggaaggtgtgataggaactgacagtttcgatcctaagcatgcaattattataacttggaaaaatgtttctttcgctgggggtatatctgacagtttgatgaggaccaacactttccaaatggtgctcgtgacagatgaagttttcacttatgccattttcaactacctccacctaggctggaccactcatacggaagcaagaggtgatacgactacaggagaaggaggtactccagcatttgttggattcaatggaggaaatggcactagaagttttgaatacaaaccatacagtcaagattcagtaatacgagatcttacatcaactggtttcgccaatggttttccaggaaggcacatattcagaatagatgaaaacattttactaggaacttgtaataaggatatagatgccggtcggttagatctcatgtttgctccagaaagtggaaacatgttaggaggaactgttgttaacataactggtccttgcttcaaaccgaatcaaaaaatcacctgcatctttgatattgctccgccagttattggcgttattgttgatagaaatagagccatttgtatacaacctccgctaatggctgaaggttgggttaggttcgagattgcagtgggaaacgagaggtttaaatggaaaggaagatattttgtcgaaacacccacaatggcagcgcaaaagatattcttttcagacatgacgtatcatgacaaatctcctgcggaaattcggatatcatgggaaaataagaacttaacatctaacgtaaatgcgaatataagaatttcactatggggttatagagaaacactcgtatctccccaattcgtttatataacccaattggcgacgaacatacaaaacaccggagaatacgtgattgtcccatctcaatacagattgaatgaaaacaagtttcaacaagatataactgtcggtttcatccagatcaacctgactgattcgatacctgttggtaacagtagcgtgaaaataacaccgctcatatggagcagacccattcctttggcgtggtactttggtccacaatggcagaggttatatggaaacagctggccttcagttctttgtgataattggatcaaggatgatcgttatctgagtaatttcgctcatgaattacctcaatgtccttgtactttacaacaagctttagttgataaaggaaggtacatgcctgggttcgattgtgacagagactcgaacccattatgctactaccaagacaatgccatacattgtgttcgatcaggtttaccaacgaatgaaggaggggaacagcaatgctgctacgataaaaataatttccttatgctgtcttatgaccaaataggaggctcaaatccgagacgttctcacaatttaggtttcaacccttacacagaatctacaaaagtacccggtttgtcacagtggtaccacgacatgatcccgaagtttgtctgttgtcgctggcaagacaaccaagcagtcggttgtgaaaccttcaggtttgaaagacgaccaactcaagattgtacagcttaccaaggacctgccgtggctggggtatacggagatccccatgtaatcacgtttgatggattggagtacacattcaacggaaagggccagttcgttcttgtgaaaaccaacgttgcctcgcaaaggttagaggttcaagcaaggttcgagcagatgcaaccaaatcaattcaatgaggttagagccactcagttgacgtctatagccattagagggaatgcttcaactatcattgaagttagaataagaccaaaacatgcaaggtggaggtatcggatggatgttatagccaacaaggagaagagactattttttgacagaccttcattgaagttccaacatttctcaggattgacggtttacaccccaacatacatactgaaccagtcggaagtgattgtaatgcttgattctggagcaggtgtggaaatagtcgaaagtttagggtacatgagtgcaagagttttccttccatggtcgtttattaataaaactgtcggtctctttggaaactggagttttgatataacagatgatttcactcttccagatggaacgaaaaaacctatcatcaccaacataaatgactgcaaagtgtttatgacaactttggaaaactgtggatgatagacgactccgaagattcgcaaacaggacaatctcttttcgttaacgaatttggacgtactgctgcatactataacgacctcgactttgtaccagaattccgaatgaacattagagatctgctaataccaaccaacgcatcggattattatatacagcaggcatacaaagcatgcaccaacaaagactaccaatgcttgtatgattacgcaatgacattggacaaagactgcgcattctatacaacaatattcaaatcaggtttgaaaaatataagagaagctagcggtgaacagactgtatcatgcggtgttctggaaaccccaaggttcggttggaaatcgaatttttcttcactcctggaagtaaagttagtttcgaatgcgctcaagatttcgttcttgacggggatcctagaagagaatgcatggaaaatggacaatggaacctacccgaattcggattcacggaatgtttacgtcaagaagaatattcgttgagacaagcaggaactacatatggaataatcctggcagtgatgattcctcttattcttctactagttttctttggattcagatttatgcgtaaactatctgaacaaaatgaccagaccaatcaagaaaaactgactatggagcaacagaaaaggttggcacaggagagggcagcgaaaaaattaacagatgtcgatgatgagcataatgatctattttcagaacattctcaatgttatcagcaatatcaatggttttctacatgaatatatcttcaaatgtgtgaaaaa

SEQ ID NO: 706 - DNA, 982 bp, Diabrotica undecimpunctata
  misc_feature (1)..(982): RNAi target sequence ta01950.01_diaun
tgaaaaagcaaatcactacgacttgccggattttgtagtagtgttaattttgtattagaaaatcaaaatgagttctattggaactgggtacgatttgtcagcttcccaattctctcctgatggaagagtttttcaagttgaatatgcaatgaaagcagttgaaaatagtggcactgtaataggtctccgaggtacagatggaattgtattagctgctgaaaagcttattatgtcaaaattacatgaacccagtacaaacaaacgaattttcaacattgataaacatataggaatggcattttcaggtttaatagctgatgcaaggcaaatagttgagattgctagaaaagaagcatcaaattataggcaccaatatggatcaaatattcctcttaaatacctaaatgatagagtaagcatgtacatgcatgcatacactttatacagtgctgtcagaccatttggttgcagtgtcatattgtccagttatgaagataatgacccatctatgtttttgattgatccatctggagttagctatggatactttggatgtgctacaggaaaagctaaacagtctgcaaagactgaaatagaaaaattgaagatggggaatttaacatgcaaagaacttgttaaagaagcagccaaaataatttatttggtccatgatgaattgaaggataagaattttgaactggaactttcatgggtatgcaaagatacaaatggtttacataccaaagtgcctgagtcagtgtttgctgatgcagaaaaggctgctaagcaagcaatggaagcagattcagaatcagatacagaagatatgtaataactacatttagtttttaatatttcactgatggtggctgttcttacaatattcgtgtgttatgtctataaattatgtaatactgtgagaatttccatttcaatgataggtttataactttttttctaataaatacataattttaaaaaa

SEQ ID NO: 707 - DNA, 795 bp, Diabrotica barberi
  misc_feature (1)..(795): RNAi target sequence ta01738.01_diab
tgacactgcaaccaaatggtctaacagcaccgtaataggccttcgaggtacagacggcattgtattggctgctgaaaagctcattatgtcaaaattgcatgaaccaagtacaaataaacgaattttcaacattgataaacacataggaatggcattttcaggcttaatagctgatgcaaggcaaattgttgagattgctagaaaagaagcatcaaattatagacaccaatatggatcaaatattcctcttaaatacctaaatgatagagtaagcatgtacatgcatgcatacactttatacagtgctgttagaccatttggttgcagtgtcatcttggccagttatgaagatagtgacccatctatgtatctgattgatccgtctggagttagctatggatactttggatgtgctacaggtaaagcaaaacagtctgcaaagactgaaatagaaaaattgaagatggggaatctaacttgcaaagaacttgttaaagaagcagccaaaatcatttatttggtccatgatgagctaaaggataagaattttgaactggaactttcatgggtatgcaaagatacgaatggtttacataccaaagtgcctgaatcagtgtttgctgatgcagaaaaagctgccaaacaagcaatggaagcagattcagaatcagatacagaagatatgtaataactagatacatttagtttttaatatttcgctgatgtggctgttcttacaatatttcatgtgttatgtccatatattatgtaatactgtgagaatttccatttcaa

SEQ ID NO: 708 - DNA, 993 bp, Epilachna varivestis
  misc_feature (1)..(993): RNAi target sequence ta26097.001_epiva
atttgtatatttataatcatagataatatataatatatttaggttttcaatcaagtaataccaaattattaatataaaatgagttctatcggcactggctatgatctttcggcttctcaattttctcctgatggtagagtttttcaagtcgaatatgctatgaaagctgtggaaaatagtggaacagttataggtcttaaaggaactgatggggtagtacttgcagcagaaaaattaatcatgtctaaactacatgaatctggcaccaacaaaagaatttataatatagatacacatattggaatgtgtttttctggtcttattgctgatgctaggcaattagttgatatagcgagaaaggaggcatcaaattatagatcacagtatggtgtaagcattccactcaaatatcttaatgacagagtcagcatgtatatgcacgcatatacactttacagtgctgtaagaccctacggctgtagcattattcttgctagttatgaggaagatcagcctatgatgtatttaattgacccctcaggtgtaaactatggatttaatggttgtgctactggaaaagcaaagcaatctgctaaaacagagattgaaaaactgaaattgggtgagctgagttgcaaagagttggttagagaagctgccaaaattatttacttagtccatgatgagttgaaggataaaaattttgagcttgagttatcatgggtgggaaaagatagcaatggtagacatgaaaaagttcccagccacgttttagctgatgctgagaaagcagcaaaacaagcaatggaggcagattccgattctgatactgaggatttgtagatatacatttgattattttataagtgcagttctaataaagcgtaatttctttcaatgtgtcatcttaaataacgccctttttcttgtaattaacgtcaaagaaaaaactcattacaaacaatttgttctgtaccataatgtgttcattgg

SEQ ID NO: 709 - DNA, 936 bp, Leptinotarsa decemlineata
  misc_feature (1)..(936): RNAi target sequence ta37784.0003_lepde
caactatttgagtatttgacagatgagttgtattttaagaaagaagcaaatcacgctagttcaaaactccaaaactaaatttttaaaatcgaatttaaacagtcaatatgagttcaataggaactgggtatgacttgtcggcttcgcaattctcacctgacggaagagtcttccaagtcgaatacgccatgaaagccgtagaaaacagtgggaccatcattggcctcaagggcactgacggaatcgtcctggcagccgagaagctcatcatgtctaaactgcatgaaccgggaacgaacaggagaatcttcaatatcgatagacatattggaatggcgttctctggcctgatagcggatgctcggcagatcgtcgaaatcgctaggaaagaggcagctaattataggctccagtacggcattaacatacctctgaagtacttgaacgacagagtgagcatgtacatgcatgcatataccttgtacagtgccgttcggccttacggatgcagcgttatattagctagttacgatgaggatgagcctcagatgtacctaattgatccatcaggagttagctatgggtttcacggctgcgcaacagggaaagcgaaacagtcggccaaaaccgaaatagagaagctcaaactaggcaatttgacatgtaaagaattggtgaaagaagcagcaaaaataatatacatggtccatgacgaactcaaagacaaaaactttgaaatggagctttcttggatatgtaaagaaagcaatgggttacacgtgaaagttcctgaatccgtatatttggaggcagaacgggccgccaagcaagccatggaagctgattcggaatcggataacgaggacatgtgaggctttgtcagttagtattaagattatggcttagttgtaagatgtcttggctaaatcttttttt

SEQ ID NO: 710 - DNA, 927 bp, Orius insidiosus
  misc_feature (1)..(927): RNAi target sequence ta09672.01_oriin
aggtaacattacatttgaggccgcatattttgctttatcattactttaaatttaattttacttttatttcttgttaaaacgtttgtttgacatcaaaaatgagttccatcggtaccgggtatgatttgtcggcgtcacaattttcgcccgacggacgagtctttcaagtagaatacgctcagaaagccattgaaaacagtgggacggtaatcggcctgagaggtaaagatggtgttgtcttggctgtcgaaaagcttgtcacgtcgaaactgtatgaaccaggagccaataaaaggatattcactattgacaaacatatcggaatggctgttgctggcttgatatctgatgcgaggcaggtggcggaagtcgctaggaccgaagctgctaattatcgctcccaatacggaagtaacatcccgttgaagtatttgaacgagcgagtctccggttatatgcatgcatatactttatacagcgctgtccgacctttcggctgcagcgtcatcctcagcacttacaacgagcgagatggacccgaaatgtacatgattgacccatcaggtgtctcatacggttatttcggatgcgctgtcggcaaagcgaaacaagccgccaaaaccgaaatcgaaaaattaaaattgaaagatttaacatgcaaagaattagtcaaagaagctgccagaataatttatttggtccatgatgagcttaaagataaacagtttgaacttgaaatgagctggatcggcgctcatacaaacggtgtaaaccaagttgtcccgccgaccgtccacgccgaagctgaaaaagatgcgaaagctgctatggaagaagattcagattctgaaactgaagatatttaacttaattatactatgttctaattaacttttttccattaataactttttttttctattcaaa

SEQ ID NO: 711 - DNA, 1115 bp, Coleomegilla maculata
  misc_feature (1)..(1115): RNAi target sequence ta36121.0001_vibdu
caatgagttgtggatttcagatttgaaggatcatataaaattgtttgcttgaaacataaattacaatttcattctaatttaataaaggaaaaatgagttcaataggcactggttatgatctttctgcgtcacaattctcgccggatggtagagtttttcaagtggaatacgctatgaaagctgttgaaaacagcggaacagtaataggtcttaaaggtacagatggaattgtcctagcagcagagaaattaattacctctaaattacatgaaccaggaacaaataagaggatattcaatatagatacgcatattggaatgtgtttttcgggtttgatagctgatgctaggcaactggtggatatagctagaaaagaagcggctaactatagatcacaatatggtgtgagcattccactgaaataccttaacgatagagtgagcatgtacatgcatgcttacactctatatagtgctatcagaccttatggttgtagtgtaattctagcaagctatgaagaaaatcaaccatttatgtatttgattgatccttctggagttagctatggttacaatgggtgtgctacaggtaaagcgaaacagtcagcaaagaccgaaattgaaaagttaaagttgggcgaattgagctgcaaggaattagttagagaagcggctaaaattatttaccaagtacatgatgaattgaaagataagaattttgaacttgaattatcatgggtaggaaaggatagtaatggtagacatgaaagagtaccaagtcatatttatgctgatgccgaaaaagctgctaaacaagcaatggaagcagattcagattctgatacagaggatttataagttttaactttattatttaagttcactcagaaattaataaatgttttgacttacattttttttaagacattatgttatagccacattttctctatccatttatatcatttatatcaacaattctttaaaactgaaggaccgaaattttagttaacaatactcgataaaatatgaaataatttcaaagcaattgaaagattggttaatataggttgaaatgttttagaggctgcaacagtgatttgtagaattttgcaa

SEQ ID NO: 712 - DNA, 853 bp, Diabrotica undecimpunctata
  misc_feature (1)..(853): RNAi target sequence ta07256.01_diaun
cattattgtaccgtgttgtctagcggatattttagatttaacaatcttattttataaaataattagttaaaatgatgcaaaccgccaataatgtatattatcccgattattccactgctccaatgcaacgtcaaattaatccttatgccgacaatggagggagtgtagtagcaatagcaggtgaagactttgtaataattggtgcagatacacgtttgagtgctggattttccatttacactagagaacaaaacaaactattcccgctatcaggcactacagttttaggctgtgcaggatgttggtgtgatactctaacattaaccagaatccttaaatctcgcatgcagatgtaccaacaagagcataacaaaacaatgtctacaactgcatgtgcccaaatgttgtcaaccatgctctactacaagagattctttccttattatatatcaaacattcttgttggtttagataatgaaggaaagggctgtgtttacagctatgatccaatcggacattgtgaaaaagctacttatagagcaggtggttcggctggagctctgctccaaccccttttggacaatcagattggacaaaagaacatgcttaaaacatctggagaacctcttagtcaggagaaagctttggctacactgaaagatgtatttatttctgctgctgaaagagatatctacactggagatagtgtacttataaatattattactaaagatggagtaaaggaagagtccttccagttgagaagggattagaagcaagtgtttttgtttatattattttcttatgtgtaattcaaatatactttctaaataaacaattttaagataaaaaa

SEQ ID NO: 713 - DNA, 856 bp, Diabrotica barberi
  misc_feature (1)..(856): RNAi target sequence ta07284.01_diab
gcataggggttaatttgacgttgcattggaccagcggattttagattcaacaagcttattttataaaataattagttaaaatgatgcaaacagctaataatgcatattatcccgattattccactgctccaatgcaacgtcaaattaacccctatgcagataatggagggagtgtagtagcaatcgcaggtgaagactttgtaataattggtgcagatacacgtttgagtactggattttccatctataccagagaacaaaacaaacttttcccactatcaggcactacagttttgggttgcgcaggatgttggtgtgacactctaacattaaccagaatccttaaatctcgcatgcagatgtaccaacaagagcataacaaaacaatgtctacaactgcatgtgcccagatgttgtctaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggagaacctcttagtcaggagaaagctttgtctacccttaaagatgtatttatttctgctgctgaaagagacatctacactggagatagcgtacttataaatattattactaaagatggagtaaaggaagagtccttccagttgagacgggattagaagcaagtggttttgtttatattttcttatgtgtaattcaaattaatatactttctaaataaacaattttaagt

SEQ ID NO: 714 - DNA, 796 bp, Epilachna varivestis
  misc_feature (1)..(796): RNAi target sequence ta27792.001_epiva
agtgagtttgttgttctagtagagtaaataccgaataaaaatgcattcaataatgaatgattctcgtccatttttcgaagattattctgttaagccaatgcagcgtcaattcagcccctacgctgataatggagggagcattattgcaatttctggtaacgacttcgtggtgattggtgcagatactcgtttgagttctggattttcgatatacactcgggatcaaaataagttattcaaactctcagataatacagttttgggatgttctggatgttggtgtgatactctttctttaactcgtattttgaacgcacgtatgcaaatgtatgaacaagaacacaataagaaaatgtccactccagcttgtgctcaaatgttatcgaccatgttatattacaagcgattctttccgtattacatttctaacatattagttggtttggattctgagggaaaaggatgtgtttatagttacgatcctattggtcatactgaaagatctagttatagagctggaggatcagcaggtgccttactacaacccctcttagataatcaagttggtatgaaaaatatccagaatgcacataatgaaccactaactattgaaagagctgttggaattttaaaggatacatttatatctgcagctgaaagagatatttatacaggtgatagcattaagatcaatgtcatcactaaagatggcatcaaagaagatacttttgagttgaggaaagattaaattgtatactttttaatatcttcaataaaaatttaattataaaaaaaa

SEQ ID NO: 715 - DNA, 842 bp, Leptinotarsa decemlineata
  misc_feature (1)..(842): RNAi target sequence ta37916.0001_lepde
tttttttatattttcggcttgtcattctagttgacttgtttaaaagtagaaagtatttgtgtttcctccactataaaatgcaaacagcaatgaacgcttattatcctgattattcaacggtaccggttcagcagtctttcagcccctatgctgataatggagggagcgtagtggccatagctggagatgatttcgtggtagtgggagcagatacacgtctaagcgccggcttctccatctacactagagaccaaaataagttgtttcctctttcaaaaacaacggttctcggatgctcaggttgctggtgtgacacgctaacgttaactcgtattttgaagtctcgcatgcagatgtacgagcaggagcataataaagtaatgtcgaccactgcttgcgcgcagatgctctccaccatgctctactacaaacgcttttttccttattacatctctaatgttctcgtgggtctcgacaacgaaggaaaaggttgtgtttacagctacgaccctattggacattgtgaaaagactacgtacagagctggtggttctgctggggctctgctccagcctctgttggataatcaaatcggacagaagaatatggagatagtgtctaccgagcccttgtcgaaagagagagctctggctatattgaaggatgtcttcatctctgcagccgagagagacatatacaccggagatagtgtttctatcaatatcataactaaggatggtgtgaaagaggaatcatttgaattgaggaaagattagaggaattttatattgaattttccttcatgaatttttgattatatgatttaagtaaaaaaaaaagtc

SEQ ID NO: 716 - DNA, 755 bp, Orius insidiosus
  misc_feature (1)..(755): RNAi target sequence ta09310.01_oriin
cgcttccgatactcgtttgagccaaagcgaaaaatttttgtttggtcatctgctgtacggtattagctgaagaaatgtctttttcaccgtattctgataatggagggagcatcgttgctgtcgccggtgacgattattcgatcatcgcttccgatactcgtttgagcgctgggtattcgatttatacgcgtgagcagtcgaaattgttcccgctgtcggaaaaagcgattttgggaagcgctggatgttggtgtgacgttctttctcttgctagattgctccagacgcgcattaaaatgtacttgtatgagcataataaggcgatgtcaactccagctatagcgcagatgctatctatcataatgtactataaacgattctttccgtattacacgtcgacaattttggccggattagattccgagggtaaaggaatcgtctacagctacgacccaatcggtcatatggaaagctctaaatatcgtgctgcaggttctgcaggagcacttctccagcctcttcttgacagccagctgggcaagaaaaaccaggagaatgtcgtgaataaatcgtacagcttggaagaagctttggcgatcgtgaaggacacttttatttcggctgctgaaagagatatttatactggagacagcatcgctttagccatcatcactcaagatggcgtcaaaaacgagactttccaactgaggaaagattaaaaacatattatttgtactatttttgctctttttgaa

SEQ ID NO: 717 - DNA, 813 bp, Coleomegilla maculata
  misc_feature (1)..(813): RNAi target sequence ta23917.0001_vibdu
gaaaatgtctataatgaatgattctcgtcctattttcactgattattctcaaaaacctatgcagcgacaatttagtccctatgccgataacggagggagcatcattgctatagctggagacgattttgttgttatcggagcagatactcgcttgagtgctggttattccatatacacccgcgatcaaaataaactctttaaattgtctaacacaacagtattgggttgttctggttgttggtgtgatactcttactctaacaaggattctgaatgcccgtatgcaaatgtatgaacaagagcataataagattatgtctactcctgcttgtgctcaaatgctttcaaccatgctatattataaacgattctttccttactatatatccaatatattggcaggcttggactctgacggaaaaggctgcgtatacagttatgatccaataggtcatacagaacgctctgcttatagagctggtggatccgcaggtgttctactgcaacctcttttagacaaccaaattggccttaaaaatatggttaatactccgaatttgcctctgaccattgaaagagctgttggaattttaaaagacacattcatctctgctgcagaaagagatatacacactggtgatagcatcaaaattaacataataactaaagatggaattaaggaagacacttttgaattgagaaaagattaaacatttttattttttgtcaacaatgggtaaaaattatctaattttgaggatgttattgtgagtgtctctcaagtatttaattataactccgaaatataaaaaaa

SEQ ID NO: 718 - DNA, 785 bp, Diabrotica undecimpunctata
  misc_feature (1)..(785): RNAi target sequence ta08127.01_diaun
tttttttagtgcaaaacttattttttttattttaatatataccaaaacataccaaagcttaaaaaataattaattaaccttcataaaatttgggcaattcatttcctaaaataactcttcgttcaataccagcttcattgataattcccagtctgactacacctcctgaagaaccatctctggacatagcaagtgccaatgtatttgtgacaaacttcacacattcttctttgctcatattgggtttgaaattggcatctacataaccataaacataactggaacctgatcctcctattgacacttcttgcctcacacacatcccaccaattggtatggaatagacttgaccgcctttcttcttatcccaacctgctaccagtattccagccattagtgaatctctataattgtagcaaagttcttggaaaatggcagcacctacttctactttgggttcttcaccaagttccataccatgaaaattaagatgataagcaacaatgtctgcaattgcttgtgtatctgctgcagatccggaacgacaacagtagatatggtcagtgactttggtgagtttgtctgctacacggtttgctatgtaagccccagtagttgtgcgagaatctgctcctataacaacgccgccgtcaaactctgcggccataatagaggtgcctgtactgtgagcagcatctctccaatcatcaggaccagtcattgcaccaaactcattcataagaggcatttttataagtttaatttcaagaatacaagctgagaaa

SEQ ID NO: 719 - DNA, 842 bp, Diabrotica barberi
  misc_feature (1)..(842): RNAi target sequence ta05581.01_diab
tttttggtgtaaacctgatttttttattttaatatataccaaaacataccaaagcttaaaaaataattaattaaccttcataaaatttgggcaattcatttcctaaaacaactcttcgttcaataccagcttcagtgatgatccccagtctgactacacctcctgaagaaccatctcttgacatggcaagtgccaatgtatttgtgacaaacttcacacattcctctttgctcatgttgggcttgaagttggcatctacgtaaccataaacataactggagcctgatcctccaattgacacttcttgtctcacacacatcccaccaattggtatggaatagacttgtccgcctttctttttatcccaacctgctaccagtataccagccattagtgaatctctataattgtagcaaagttcttggaaaatggcggcacctacttgtactttgggttcttcaccaagttccataccatgaaaattaagatgataagcaacaatgtctgcaattgcttgtgtatctgctgcagatcctgaacgacaacagtatatatggtcagtgactttggtgagtttgtctgctacccggtttgcaatgtaagccccggtagttgtgcgagaatctgctcctataacaacgcctccatcaaactctgcggccataatagaggttcctgtactgtgagcggcatctctccaatcattaggagcagtcattgcaccatactcagtcataagaggcattttttacaagtttaatgaaaagaatacaagcttagaaaaattacttgtaatcctacaatccaatattttgccagtcaccagctcctataacaacgcc

SEQ ID NO: 720 - DNA, 935 bp, Epilachna varivestis
  misc_feature (1)..(935): RNAi target sequence ta23856.001_epiva
cgatcttaaaaatcggatttatatcgtgattattgtaataattattctcacagctagccgaataatttcgtttcgcgttactggtaacactgaaaatgcatttttcattttgtggttatgattatttggagaaaaataatttgtcatagtcattgagtacaaattgtgttcgatatatttgcaatattagattcattaaacttgattttatactgaaaatcacaaactaccatcgaaaacatggactccgattggatgaatgcaccacacagtacagggacttctattatggctgctgagtttaatggtggagttgttattggtgccgacactagaacaactacaggggcatacatagccaaccgagtaacggataaactaacaaaagtaacagatcacatttattgttgtcgttctggttcagcagcagatactcaagctattgctgatatagtttcttatcatctaggatttcatggaattgagttgggagaagagccacttgtagaaacaagtgcagctgtgtttcaagaactttgttacagctatcgtgattctttaatggctggaattctagtagcaggttgggataaacgtaaaggtggtcaggtttattctattcctataggtggaatgtgtgtaagacagagcgtatccataggtggttcaggatcaagctatgtttatggttatgttgatgccaattataaacctggaatgtcaaaagaagcttgtgtagactttgtttcaaaaactttggcacttgcaatgtcaagagatggttcttctggtggttgtattcgtattggagtcattacaaaggatggcattgaacgcaaggttattctgggttctgaggtccctaaattctatgaagattgattttatttgtattcaattaaataataaataaaaatgttaacatctaaaaaaaa

SEQ ID NO: 721 - DNA, 1264 bp, Leptinotarsa decemlineata
  misc_feature (1)..(1264): RNAi target sequence ta33564.0001_lepde
tttacataattacggaatactgtgccatagattacagaaatttaaattttagtgttctgtggttctaacctagcaaataatttgtagagtcattttttgacttattttttgttagtgattttgtattcagattgtctccgttcgtaaaaatgctactgaatcaaatatccatagcaggtgccgatgactggagaaatgccgctcatagcactgggacttctattatggcagcagaattcgatggaggagtaattattggtgctgattcccgtacaactacaggggcgtacattgcaaatcgtgtaactgacaaactaactaaagtaactgaccatatatattgttgtcgatctggatcagcagcagatactcaagccattgctgatattgtatcgtaccatctgaacttccatggtatggaactaggagaagagccccttgtagaggtgggggctgctatcttcagggagctttgctacaactatagggattctctcatggcgggaatcctagttgctggctgggacaaaaaaaaggggggacaaatttattctattcctatcggagggatgtgtgttaggcaagcggtttctattggaggttcaggttccagttatgtttatggttatgtagatgctaatttcaaacccaagatgtcaaaggaggaatgtgcgaaatttgtcacaaatactctggctcttgcaatgtctagagatggatcatctggaggtgttatccgtctaggtataattacggagtcgggaattgaacgtcgtgtcatcttaggcgatgatctacccaagttctatgaaggatagagcatataataatcataatttttcattttgtaattggtgtcaataaatcaaataaaataaggttttctttaaaaaacaattatatgattataaaatacatgttaatgaacaatgaatttgaaagagaaaaaagatggttgtgtaccatgaaggcactaattcgtatctttattaatgtagtctgtatttttagagagaatcgtgacaaaattagtcgcatggcgccatttggcaccaacatattttgaattcctttattttttctggaactctggtaataaaattatttctgttatatcttagtattcaaaatgccactgaaaaaattgaatcattattttcttaccaattctttttcttaagaagatatcgttacagcactaccatcaccacaaacagatttaccattttttttgtcaaccttctaaattttacagtaaatgtat

SEQ ID NO: 722 - DNA, 912 bp, Orius insidiosus
  misc_feature (1)..(912): RNAi target sequence ta09100.01_oriin
ttcagaattagctatttaaccgaaggcgactcagcgaatttactaagtgaaggtgaactattctgtggagaaaaatggccaaagtcgctgttcatcatgatcgtttcggtgcccctgcaatgactgaggaaccagtttctactggaactacaattatggcttgtacttttgacggaggcgtcatcatcggtgcggattctaggacgagtagcggaccttacgtcgccaatcgcgtttccgacaaactgacaaaaatctccgatcacatttactgttgtaggtcaggatcggccgctgacactcaagctatcgctgatatcgtcaaatatcacctttctttttttaagcttgaaactggtgaagaaccgcttgttgcaactgctgcagcgattttccgtgagctttgttataactacagaaatcgcttgatggctggcatcatcgtcgctggatgggacagagttaaaggcggacaggtttatacgatacctttgggtggtatgataatcgagcagaaattcgcaatgggcggttctggaagttcttatgtttatggcttcactgatgccaactatagagaaaacatgagttcagaagaatgcaaacagttcattaaacaagcaatcgctcttgccattcgtcgtgacggctcttccggaggtgtcataagaatgggtctcatcacaaaagatggtattaaacgagaaattttttcgggtaaagattacccttcatatttaactccagctaaagattagaatatctttttgtattccttgagctgtaaaatttaagtacattcatttataactttttgaaatgattttctttcatttattaacaaaataatccagtactaataatactccagcaagtactatttcaatacacatctttatcacaaaggcaaaa

SEQ ID NO: 723 - DNA, 686 bp, Coleomegilla maculata
cctcacagtacaggaacctctatcatggctgctgaatttgagggtggtgtagtaattggtgctgattctagaaccaccacaggaacatatattgccaatcgagtaactgataagcttacaaaaataactgatcgtatatattgttgtcgatctggttcagctgctgatacccaagccattgcagatattgtatcttatcatttaggtttccatgggatggaattgggagaagaaccacttgtagaaactagtgctgcagtattccaagaactatgctataattatcgagattctttgatggctggtatacttgtagcaggatgggataagcgaaagggaggtcaaatttactcaattcctattgggggaatgtgtgtgaggcaaaaagtctctattggaggttctggttctggttttgtatacggctatgtagatgctaactataagtctggaatgactaaagaagcttgcgttgatttcgtaattaaaactttggcacttgctatgtcgagagatggctcatcaggtggttgtgttaggattggagttataactaaagatggtatcgaacgtaaagtaattttgggtacagaattacccaaattttatgaagattaatatttcataatatattttgtcttaattcaatacttcattcaataaaattatgaaattttcgaaaaaaa

That which is claimed:

1. An isolated polynucleotide comprising a heterologous promoter operably linked to:
    (a) a nucleotide sequence comprising SEQ ID NO: 569 or the full length complement thereof;
    (b) a nucleotide sequence comprising at least 95% sequence identity to the nucleotide sequence of SEQ ID NO: 569 or the full length complement thereof; or
    (c) a nucleotide sequence comprising at least 24 consecutive nucleotides of SEQ ID NO: 569 or the full length complement thereof;
    wherein said isolated polynucleotide encodes a silencing element having insecticidal activity against a Coleopteran plant pest.

2. The isolated polynucleotide of claim 1, wherein said Coleopteran plant pest is a *Diabrotica* plant pest.

3. An expression cassette comprising the polynucleotide of claim 1.

4. The expression cassette of claim 3, wherein said silencing element comprises a double stranded RNA.

5. The expression cassette of claim 3, wherein said silencing element comprises a hairpin RNA.

6. The expression cassette of claim 5, wherein the silencing element comprises a first segment, a second segment, and a third segment, wherein
    a) said first segment comprises at least 24 consecutive nucleotides complementary to the sequence-set forth in SEQ ID NO: 569 or the full length complement thereof;
    b) said second segment comprises a loop of sufficient length to allow the silencing element to be transcribed as a hairpin RNA; and,
    c) said third segment comprises at least 24 nucleotides having at least 95% complementarity to the first segment.

7. The expression cassette of claim 3, wherein said polynucleotide is flanked by a first operably linked convergent promoter at one terminus of the polynucleotide and a second operably linked convergent promoter at the opposing terminus of the polynucleotide, wherein the first and the second convergent promoters are capable of driving expression of the silencing element.

8. A host cell comprising a heterologous expression cassette of claim 3.

9. A plant cell having stably incorporated into its genome a heterologous polynucleotide comprising:
    a) a nucleotide sequence comprising at least 24 consecutive nucleotides of SEQ ID NO: 569 or the full length complement thereof; or,
    b) a nucleotide sequence comprising at least 95% sequence identity to SEQ ID NO: 569 or the full length complement thereof;
    wherein said polynucleotide encodes a silencing element having insecticidal activity against a Coleopteran plant pest.

10. The plant cell of claim 9, wherein the Coleopteran plant pest is a *Diabrotica* plant pest.

11. The plant cell of claim 9, wherein said silencing element comprises
    a) a polynucleotide comprising a sequence complementary to a nucleotide sequence set forth in SEQ ID NO: 569 or the full length complement thereof; or
    b) a polynucleotide comprising a nucleotide sequence complementary to at least 130 consecutive nucleotides of the sequence set forth in SEQ ID NO: 569 or the full length complement thereof.

12. The plant cell of claim 9, wherein said plant cell comprises an expression cassette comprising an isolated polynucleotide comprising a heterologous promoter operably linked to:
    (a) a nucleotide sequence comprising SEQ ID NO: 569 or the full length complement thereof;
    (b) a nucleotide sequence comprising at least 95% sequence identity to the nucleotide sequence of SEQ ID NO: 569 or the full length complement thereof; or
    (c) a nucleotide sequence comprising at least 24 consecutive nucleotides of SEQ ID NO: 569 or the full length complement thereof;
    wherein said isolated polynucleotide encodes a silencing element having insecticidal activity against a Coleopteran plant pest.

13. The plant cell of claim 9, wherein said silencing element comprises a double stranded RNA.

14. The plant cell of claim 9, wherein said silencing element comprises a hairpin RNA.

15. The plant cell of claim 14, wherein said silencing element comprises a first segment, a second segment, and a third segment, wherein
   a) said first segment comprises at least 24 consecutive nucleotides complementary to the sequence set forth in SEQ ID NO: 569 or the full length complement thereof;
   b) said second segment comprises a loop of sufficient length to allow the silencing element to be transcribed as a hairpin RNA; and,
   c) said third segment comprises at least 24 nucleotides having at least 95% complementarity to the first segment.

16. The plant cell of claim 9, wherein said polynucleotide is operably linked to a heterologous promoter.

17. The plant cell of claim 9, wherein said plant cell is from a monocot.

18. The plant cell of claim 17, wherein said monocot is maize, barley, millet, wheat or rice.

19. The plant cell of claim 9, wherein said plant cell is from a dicot.

20. The plant cell of claim 19, wherein said plant is soybean, canola, alfalfa, sunflower, safflower, tobacco, *Arabidopsis*, or cotton.

21. A plant or plant part comprising a plant cell of claim 9.

22. A transgenic seed from the plant of claim 21.

23. A method for controlling a Coleopteran plant pest comprising feeding to a Coleopteran plant pest a composition comprising a silencing element, wherein said silencing element, when ingested by said Coleopteran plant pest, reduces the level of a target Coleopteran plant pest sequence and thereby controls the Coleopteran plant pest, wherein said target Coleopteran plant pest sequence comprises a polynucleotide sequence comprising at least 95% sequence identity to SEQ ID NO: 569 or the full length complement thereof.

24. The method of claim 23, wherein said Coleopteran plant pest comprises a *Diabrotica* plant pest.

25. The method of claim 23, wherein said silencing element comprises
   a) a nucleotide sequence complementary to at least 23 consecutive nucleotides of SEQ ID NO: 569 or the full length complement thereof; or, b) a nucleotide sequence complementary to at least 95% sequence identity to SEQ ID NO: 569 or the full length complement thereof.

26. The method of claim 24, wherein said *Diabrotica* plant pest comprises *D. virgifera virgifera*, *D. speciosa*, *D. barberi*, *D. virgifera zeae*, *D. speciosa*, or *D. undecimpunctata howardi*.

27. The method of claim 23, wherein said composition comprises a plant or plant part having stably incorporated into its genome a polynucleotide comprising said silencing element.

28. The method of claim 27, wherein said silencing element comprises:
   a) a polynucleotide comprising the sense or antisense sequence of the sequence set forth in SEQ ID NO: 569 or the full length complement thereof;
   b) a polynucleotide comprising the sense or antisense sequence of a sequence having at least 95% sequence identity to the sequence set forth in SEQ ID NO: 569 or the full length complement thereof;
   c) a polynucleotide comprising the sense or antisense sequence of a sequence having at least 130 contiguous nucleotides of SEQ ID NO: 569 or the full length complement thereof.

29. The method of claim 27, wherein said silencing element comprises a double stranded RNA.

30. The method of claim 27, wherein said silencing element comprises a hairpin RNA.

31. The method of claim 30, wherein said silencing element comprises a first segment, a second segment, and a third segment, wherein
   a) said first segment comprises at least 24 consecutive nucleotides complementary to the sequence set forth in SEQ ID NO: 569 or the full length complement thereof;
   b) said second segment comprises a loop of sufficient length to allow the silencing element to be transcribed as a hairpin RNA; and,
   c) said third segment comprises at least 24 nucleotides having at least 95% complementarity to the first segment.

32. The method of claim 27, wherein said silencing element is operably linked to a heterologous promoter.

33. The method of claim 27, wherein said silencing element is flanked by a first operably linked convergent promoter at one terminus of the silencing element and a second operably linked convergent promoter at the opposing terminus of the silencing element, wherein the first and the second convergent promoters are capable of driving expression of the silencing element.

34. The method of claim 27, wherein said plant is a monocot.

35. The method of claim 34, wherein said monocot is maize, barley, millet, wheat or rice.

36. The method of claim 27, wherein said plant is a dicot.

37. The method of claim 36, wherein said plant is soybean, canola, alfalfa, sunflower, safflower, tobacco, *Arabidopsis*, or cotton.

38. A double stranded RNA targeting a Coleopteran plant pest target polynucleotide, wherein the target polynucleotide comprises:
   (a) a nucleotide sequence comprising SEQ ID NO: 569;
   (b) a nucleotide sequence comprising at least 95% sequence identity to SEQ ID NO: 569; or
   (c) a nucleotide sequence comprising at least 24 consecutive nucleotides of SEQ ID NO: 569,
   wherein said double stranded RNA has insecticidal activity against a Coleopteran plant pest.

39. The double stranded RNA of claim 38, wherein said Coleopteran plant pest is a *Diabrotica* plant pest.

40. The double stranded RNA of claim 38, wherein the double stranded RNA comprises a hairpin RNA.

41. The double stranded RNA of claim 38, further comprising an agriculturally acceptable carrier.

42. The double stranded RNA of claim 38, wherein the double stranded RNA is expressed in a plant, plant part, or plant cell.

43. The double stranded RNA of claim 38, wherein the double stranded RNA is expressed in a microorganism.

\* \* \* \* \*